(12) United States Patent
Grandea, III et al.

(10) Patent No.: US 8,916,160 B2
(45) Date of Patent: Dec. 23, 2014

(54) COMPOSITIONS AND METHODS FOR THE THERAPY AND DIAGNOSIS OF INFLUENZA

(75) Inventors: Andres G. Grandea, III, Shoreline, WA (US); Gordon King, Shoreline, WA (US); Thomas C. Cox, Redmond, WA (US); Ole Olsen, Everett, WA (US); Jennifer Mitcham, Redmond, WA (US); Matthew Moyle, Newtown, CT (US); Phil Hammond, Seattle, WA (US)

(73) Assignee: Theraclone Sciences, Inc., Seattle, WA (US)

( * ) Notice: Subject to any disclaimer, the term of this patent is extended or adjusted under 35 U.S.C. 154(b) by 0 days.

(21) Appl. No.: 13/372,870

(22) Filed: Feb. 14, 2012

(65) Prior Publication Data

US 2012/0207760 A1    Aug. 16, 2012

Related U.S. Application Data

(60) Provisional application No. 61/442,733, filed on Feb. 14, 2011.

(51) Int. Cl.
| | |
|---|---|
| *A61K 39/00* | (2006.01) |
| *A61K 39/42* | (2006.01) |
| *A61K 39/145* | (2006.01) |
| *G01N 33/569* | (2006.01) |
| *C07K 16/10* | (2006.01) |

(52) U.S. Cl.
CPC .... *G01N 33/56983* (2013.01); *A61K 2039/505* (2013.01); *C07K 2317/515* (2013.01); *C07K 2317/565* (2013.01); *C07K 2317/76* (2013.01); *C07K 2317/34* (2013.01); *C07K 2317/21* (2013.01); *A61K 2039/507* (2013.01); *C07K 16/1018* (2013.01); *C07K 2317/51* (2013.01); *G01N 2333/11* (2013.01)
USPC .................. 424/178.1; 424/159.1; 424/206.1; 424/209.1; 530/387.1

(58) Field of Classification Search
CPC ............... A61K 39/145; A61K 39/12; A61K 2039/5258; A61K 2039/505; A61K 39/00; A61K 39/395; C12N 2760/16111; C12N 2760/16211; C12N 2760/16334; C12N 2760/18523; C07K 14/005; C07K 16/1018
See application file for complete search history.

(56) References Cited

U.S. PATENT DOCUMENTS

| | | | |
|---|---|---|---|
| 3,773,919 A | 11/1973 | Boswell et al. | |
| 3,896,111 A | 7/1975 | Kupchan et al. | |
| 4,137,230 A | 1/1979 | Hashimoto et al. | |
| 4,151,042 A | 4/1979 | Higashide et al. | |
| 4,248,870 A | 2/1981 | Miyashita et al. | |
| 4,256,746 A | 3/1981 | Miyashita et al. | |
| 4,260,608 A | 4/1981 | Miyashita et al. | |
| 4,265,814 A | 5/1981 | Hashimoto et al. | |
| 4,294,757 A | 10/1981 | Asai | |
| 4,307,016 A | 12/1981 | Asai et al. | |
| 4,308,268 A | 12/1981 | Miyashita et al. | |
| 4,308,269 A | 12/1981 | Miyashita et al. | |
| 4,309,428 A | 1/1982 | Miyashita et al. | |
| 4,313,946 A | 2/1982 | Powell et al. | |
| 4,315,929 A | 2/1982 | Freedman et al. | |
| 4,317,821 A | 3/1982 | Miyashita et al. | |
| 4,322,348 A | 3/1982 | Asai et al. | |
| 4,331,598 A | 5/1982 | Hasegawa et al. | |
| 4,361,650 A | 11/1982 | Asai et al. | |
| 4,362,663 A | 12/1982 | Kida et al. | |
| 4,364,866 A | 12/1982 | Asai et al. | |
| 4,371,553 A | 2/1983 | Gilling et al. | |
| 4,424,219 A | 1/1984 | Hashimoto et al. | |
| 4,450,254 A | 5/1984 | Isley et al. | |
| 4,485,045 A | 11/1984 | Regen | |
| 4,544,545 A | 10/1985 | Ryan et al. | |
| 4,554,101 A | 11/1985 | Hopp | |
| 4,676,980 A | 6/1987 | Segal et al. | |
| 4,683,202 A | 7/1987 | Mullis | |
| 4,816,567 A | 3/1989 | Cabilly et al. | |
| 4,975,278 A | 12/1990 | Senter et al. | |
| 5,013,556 A | 5/1991 | Woodle et al. | |
| 5,053,394 A | 10/1991 | Ellestad et al. | |
| 5,208,020 A | 5/1993 | Chari et al. | |
| 5,229,275 A | 7/1993 | Goroff | |
| 5,416,064 A | 5/1995 | Chari et al. | |
| 5,500,362 A | 3/1996 | Robinson et al. | |
| 5,545,806 A | 8/1996 | Lonberg et al. | |
| 5,545,807 A | 8/1996 | Surani et al. | |
| 5,567,610 A | 10/1996 | Borrebaeck et al. | |
| 5,569,825 A | 10/1996 | Lonberg et al. | |
| 5,571,894 A | 11/1996 | Wels et al. | |
| 5,587,458 A | 12/1996 | King et al. | |

(Continued)

FOREIGN PATENT DOCUMENTS

| | | |
|---|---|---|
| DE | 266710 A | 8/1985 |
| EP | 73657 A1 | 3/1983 |

(Continued)

OTHER PUBLICATIONS

Sanofi-Pasteur product information sheet for Fluzone seasonal influenza vaccine for 2009.*
Altschul et al. "Basic Local Alignment Search Tool." *J. Mol. Biol.* 215.3(1990):403-410.
Altschul et al. "Gapped BLAST and PSI-BLAST: A New Generation of Protein Database Search Programs." *Nucl. Acids Res.* 25.17(1997):3389-3402.
ATCC Accession No. 12424, retrieved Nov. 16, 2011.
ATCC Accession No. 16045, retrieved Nov. 16, 2011.
ATCC Accession No. 24178, retrieved Nov. 16, 2011.
ATCC Accession No. 27325, retrieved on Aug. 15, 2011.
ATCC Accession No. 31446, retrieved Aug. 15, 2011.
ATCC Accession No. 31537, retrieved Aug. 15, 2011.
ATCC Accession No. 36906, retrieved Nov. 21, 2011.
ATCC Accession No. 56500, retrieved Nov. 16, 2011.
ATCC Accession No. CCL10, retrieved Nov. 16, 2011.
ATCC Accession No. CCL2, retrieved Nov. 16, 2011.
ATCC Accession No. CCL34, retrieved Nov. 16, 2011.
ATCC Accession No. CCL51, retrieved Nov. 16, 2011.
ATCC Accession No. CCL70, retrieved Nov. 16, 2011.
ATCC Accession No. CCL75, retrieved Nov. 23, 2011.
ATCC Accession No. CRL1442, retrieved Nov. 16, 2011.

(Continued)

*Primary Examiner* — Benjamin P Blumel
(74) *Attorney, Agent, or Firm* — Cooley LLP

(57) ABSTRACT

The present invention provides compositions, vaccines, and methods for diagnosing, treating, and preventing influenza infection using a combination of antibodies raised against the influenza hemagglutinin and the matrix 2 ectodomain polypeptides.

3 Claims, 37 Drawing Sheets

(56) References Cited

U.S. PATENT DOCUMENTS

| | | | |
|---|---|---|---|
| 5,591,669 | A | 1/1997 | Krimpenfort et al. |
| 5,627,052 | A | 5/1997 | Schrader |
| 5,641,870 | A | 6/1997 | Rinderknecht et al. |
| 5,648,237 | A | 7/1997 | Carter |
| 5,712,374 | A | 1/1998 | Kuntsmann et al. |
| 5,714,586 | A | 2/1998 | Kunstmann et al. |
| 5,731,168 | A | 3/1998 | Carter et al. |
| 5,739,116 | A | 4/1998 | Hamann et al. |
| 5,739,277 | A | 4/1998 | Presta et al. |
| 5,767,285 | A | 6/1998 | Hamann et al. |
| 5,770,701 | A | 6/1998 | McGahren et al. |
| 5,770,710 | A | 6/1998 | McGahren et al. |
| 5,773,001 | A | 6/1998 | Hamann et al. |
| 5,789,199 | A | 8/1998 | Joly et al. |
| 5,821,337 | A | 10/1998 | Carter et al. |
| 5,837,234 | A | 11/1998 | Gentile et al. |
| 5,840,523 | A | 11/1998 | Simmons et al. |
| 5,869,046 | A | 2/1999 | Presta et al. |
| 5,877,296 | A | 3/1999 | Hamann et al. |
| 6,331,415 | B1 | 12/2001 | Cabilly et al. |
| 6,824,780 | B1 | 11/2004 | Devaux et al. |
| 7,112,439 | B2 | 9/2006 | Johnson et al. |
| 2011/0033476 | A1 | 2/2011 | Grandea, III et al. |
| 2012/0039899 | A1* | 2/2012 | Olsen et al. ................ 424/142.1 |

FOREIGN PATENT DOCUMENTS

| | | | |
|---|---|---|---|
| EP | 183070 | A2 | 6/1986 |
| EP | 244234 | A2 | 11/1987 |
| EP | 402226 | A1 | 12/1990 |
| EP | 404097 | A2 | 12/1990 |
| EP | 0425235 | B1 | 5/1991 |
| WO | WO-8101145 | A1 | 4/1981 |
| WO | WO-8807378 | A1 | 10/1988 |
| WO | WO-9013646 | A1 | 11/1990 |
| WO | WO-9100360 | A1 | 1/1991 |
| WO | WO-9202551 | A1 | 2/1992 |
| WO | WO-9220373 | A1 | 11/1992 |
| WO | WO-9308829 | A1 | 5/1993 |
| WO | WO-9311161 | A1 | 6/1993 |
| WO | WO-9316185 | A2 | 8/1993 |
| WO | WO-9321232 | A1 | 10/1993 |
| WO | WO-9404690 | A1 | 3/1994 |
| WO | WO-9411026 | A2 | 5/1994 |
| WO | WO-9616673 | A1 | 6/1996 |
| WO | WO-9717852 | A1 | 5/1997 |
| WO | WO-9738731 | A1 | 10/1997 |
| WO | WO-9802463 | A1 | 1/1998 |
| WO | WO-2008028946 | A2 | 3/2008 |
| WO | WO-2010027818 | A2 | 3/2010 |

OTHER PUBLICATIONS

ATCC Accession No. CRL1587, retrieved Nov. 16, 2011.
ATCC Accession No. CRL1651, retrieved Nov. 16, 2011.
Ayata et al. "Different Antibody Response to a Neutralizing Epitope of Human Cytomegalovirus Glycoprotein B Among Seropositive Individuals." *J. Med. Virol.* 43(1994):386-392.
Babcook et al. "A Novel Strategy for Generating Monoclonal Antibodies From Single, Isolated Lymphocytes Producing Antibodies of Defined Specificities." *PNAS.* 93.15(1996):7843-7848.
Beerli. "Prophylactic and Therapeutic Activity of Fully Human Monoclonal Antibodies Directed Against Influenza A M2 Protein." *Virol. J.* 6(2009):224-234.
Belser et al. "Past, Present, and Possible Future Human Infection With Influenza Virus A Subtype H7." *Emerg. Infect. Dis.* 15.6(2009):859-865.
Bird et al. "Single-Chain Antigen-Binding Proteins." *Science.* 242(1988):423-426.
Bitter et al. "Expression and Secretion Vectors for Yeast." *Meth. Enzymol.* 153(1987):516-544.
Bolton et al. "The Labelling of Proteins to High Specific Radioactives by Conjugation to a 125I-Containing Acylating Agent." *Biochem. J.* 133.3(1973):529-538.

Brennan et al. "Preparation of Bispecific Antibodies by Chemical Recombination of Monoclonal Immunoglobulin G1 Fragments." *Science.* 229(1985):81-83.
Broglie et al. "Light-Regulated Expression of a Pea Ribulose-1,5-Bisphosphate Carboxylase Small Subunit Gene in Transformed Plant Cells." *Science.* 224(1984):838-843.
Brüggemann et al. "Designer Mice: The Production of Human Antibody Repertoires in Transgenic Animals." *The Year in Immunology: Generation of Antibodies by Cell and Gene Immortalization.* Terhorst et al., eds. New York: Karger. 7(1993):33-40.
Capel et al. "Heterogeneity of Human IgC Receptors." *Immunometh.* 4.1(1994):25-34.
Carlsson et al. "Protein Thiolating and Reversible Protein-Protein Conjugation." *Biochem. J.* 173(1978):723-737.
Caron et al. "Engineered Humanized Dimeric Forms of IgG are More Effective Antibodies." *J. Exp. Med.* 176(1992):1191-1195.
Carrat et al. "Influenza Vaccine: The Challenge of Antigenic Drift." *Vaccine.* 25(2007):6852-6862.
Carter et al. "High Level *Escherichia coli* Expression and Production of a Bivalent Humanized Antibody Fragment." *Bio/Technology.* 10(1992):163-167.
Casadevall. "Antibodies for Defense Against Biological Attack." *Nat. Biotech.* 20(2002):114.
Chari et al. "Immunoconjugates Containing Novel Maytansinoids: Promising Anticancer Drugs." Cancer Res. 52(1992):127-131.
Chothia et al. "Canonical Structures for the Hypervariable Regions of Immunoglobulins." *J. Mol. Biol.* 196.4(1987):901-917.
Chothia et al. "Conformations of Immunoglobulin Hypervariable Regions." *Nature.* 342(1989):877-883.
Clackson et al. "Making Antibody Fragments Using Phage Display Libraries." *Nature.* 352(1991):624-628.
Clynes et al. "Fc Receptors are Required in Passive and Active Immunity to Melanoma." *PNAS.* 95.2(1998):652-656.
Clynes et al. "Inhibitory Fc Receptors Modulate in vivo Cytotoxicity Against Tumor Targets." *Nat. Med.* 6.4(2000):443-446.
Colbére-Garapin et al. "A New Dominant Hybrid Selective Marker for Higher Eukoaryotic Cells." *J. Mol. Biol.* 150.1(1981):1-14.
Corti et al. "Heterosubtypic Neutralizing Antibodies are Produced by Individuals Immunized With a Seasonal Influenza Vaccine." *J. Clin. Invest.* 120.5(2010):1663-1673.
Coruzzi et al. "Tissue-Specific and Light-Regulated Expression of a Pea Nuclear Gene Encoding the Small Subunit of Ribulose-1,5-bisphosphate Carboxylase." *EMBO J.* 3.8(1984):1671-1680.
Cunningham et al. "High-Resolution Epitope Mapping of hGH-Receptor Interactions by Alanine-Scanning Mutagenesis." *Science.* 244(1989):1081-1085.
Daëron. "Fc Receptor Biology." *Annu. Rev. Immunol.* 15(1997):203-234.
Dayhoff et al. "A Model of Evolutionary Change in Proteins." *Atlas of Protein Sequence and Structure.* Washington, D.C.: National Biomedical Research Foundation. Dayhoff, ed. 5.S3(1978):345-358.
de Haas et al. "Fc Gamma Receptors of Phagocytes." *J. Lab. Clin. Med.* 126.4(1995):330-341.
Engelhard et al. "The Insect Tracheal System: A Conduit for the Systemic Spread of *Autographa californica* M Nuclear Polyhedrosis Virus." *PNAS.* 91.8(1994):3224-3227.
Eppstein et al. "Biological Activity of Liposome-Encapsulated Murine Interferon Gamma is Mediated by a Cell Membrane Receptor." *PNAS.* 82.11(1985):3688-3692.
Fan et al. "Preclinical study of Influenza Virus A M2 Peptide Conjugate Vaccines in Mice, Ferrets, and Rhesus Monkeys." *Vaccine.* 22(2004):2993-3003.
Feng et al. "Influenza A Virus Infection Engenders a Poor Antibody Response Against the Ectodomain of Matrix Protein 2." *Virology J.* 3(2006):102.
Fouchier et al. "Avian Influenza A Virus (H7N7) Associated With Human Conjunctivitis and a Fatal Case of Acute Respiratory Distress Syndrome." *PNAS.* 101.5(2004):1356-1361.
Fraker et al. "Protein and Cell Membrane Iodinations with a Sparingly Soluble Chloroadmide, 1,3,4,6-Tetrachloro-3a,6a-Diphenylglycoluril." *Biochem. Biophys. Res. Commun.* 80.4(1978):849-857.

(56) References Cited

OTHER PUBLICATIONS

Fu et al. "Characterizations of Four Monoclonal Antibodies Against M2 Protein Ectodomain of Influenza A Virus." *Virol.* 385(2008):218-226.
Fu et al. "Comparative Immunogenicity Evaluations of Influenza A Virus M2 Peptide as Recombinant Virus like Particle or Conjugate Vaccines in Mice and Monkeys." *Vaccine.* 27(2009):1440-1447.
Furuse et al. "Evolution of the M Gene of the Influenza A Airus in Different Host Species: Large-Scale Sequence Analysis." *J. Virol.* 29(2009):67.
Gabizon et al. "Pharmacokinetics and Tissue Distribution of Doxorubicin Encapsulated in Stable Liposome with Long Circulation Times." *J. Natl. Cancer Inst.* 81.19(1989):1484-1488.
Gazzano-Santoro et al. "A Non-Radioactive Complement-Dependent Cytotoxicity Assay for Anti-CD20 Monoclonal Antibody." *J. Immunol. Meth.* 202.2(1997):163-171.
GenBank Accession No. AB019437, Jul. 2, 2008.
GenBank Accession No. J00248, Apr. 11, 2001.
GenBank Accession No. L10088, Nov. 9, 1994.
GenBank Accession No. M29812, Feb. 26, 2002.
GenBank Accession No. M95114, Apr. 27, 1993.
GenBank Accession No. M95117, Apr. 27, 1993.
GenBank Accession No. M99679, Oct. 17, 2007.
GenBank Accession No. X56360, May 7, 1992.
GenBank Accession No. X59312, Nov. 14, 2006.
GenBank Accession No. X59315, Nov. 14, 2006.
GenBank Accession No. X59318, Nov. 14, 2006.
GenBank Accession No. X70208, Nov. 14, 2006.
GenBank Accession No. X92218, Oct. 30, 1995.
GenBank Accession No. Y14865, Oct. 23, 2008.
GenBank Accession No. Z27504, Jun. 21, 1994.
Gruber et al. "Efficient Tumor Cell Lysis Mediated by a Bispecific Single Chain Antibody Expressed in *Escherichia coli.*" *J. Immunol.* 152(1994):5368-5374.
Gubareva et al. "Influenza Virus Neuraminidase Inhibitors." *Lancet.* 355(2000):827-835.
Guss et al. "Structure of the IgG-Binding Regions of Streptococcal Protein G." *EMBO J.* 5.7(1986):1567-1575.
Guyer et al. "Immunoglobulin Binding by Mouse Intestinal Epithelial Cell Receptors." *J. Immunol.* 117.2(1976):587-593.
Hartman et al. "Two Dominant-Acting Selectable Markers for Gene Transfer Studies in Mammalian Cells." *PNAS.* 85.21(1988):8047-8051.
Hein. "Unified Approach to Alignment and Phylogenes." *Meth. Enzymol.* 183(1990):626-645.
Henikoff et al. "Amino Acid Substitution Matrices from Protein Blocks." *PNAS.* 89(1992):10915-10919.
Higgins et al. "Fast and Sensitive Multiple Sequence Alignments on a Microcomputer." *CABIOS.* 5.2(1989):151-153.
Hobbs et al. "Genetic Engineering." *McGraw Hill Yearbook of Science and Technology.* New York: McGraw Hill. (1992):189-196.
Holliger et al. "'Diabodies': Small Bivalent and Bispecific Antibody Fragments." *PNAS.* 90.14(1993):6444-6448.
Honegger et al. "Yet Another Numbering Scheme for Immunoglobulin Variable Domains: An Automatic Modeling and Analysis Tool." *J. Mol. Biol.* 309.3(2001):657-670.
Huber et al. "Fc Receptor-Mediated Phagocytosis Makes a Significant Contribution to Clearance of Influenza Virus Infections." *J. Immunol.* 166(2001):7381-7388.
Hwang et al. "Hepatic Uptake and Degradation of Unilamellar Sphingomyelin/Cholesterol Liposomes: A Kinetic Study." *PNAS.* 77.7(1980):4030-4034.
Igarashi et al. "Human Immunodeficiency Virus Type 1 Neutralizing Antibodies Accelerate Clearance of Cell-Free Virions From Blood Plasma." *Nat. Med.* 5.2(1999):211-216.
Jakobovits et al. "Analysis of Homozygous Mutant Chimeric Mice: Deletion of the Immunoglobulin Heavy-Chain Joining Region Blocks B-Cell Development and Antibody Production." *PNAS.* 90.6(1993):2551-2555.

Jakobovits et al. "Germ-Line Transmission and Expression of a Human-Derived Yeast Artificial Chromosome." *Nature.* 362(1993):255-258.
Jameson et al. "Human Cytotoxic T-Lymphocyte Repertoire to Influenza A Viruses." *J. Virol.* 72.11(1998):8682-8689.
Jegerlehner et al. "Influenza A Vaccine Based on the Extracellular Domain of M2: Weak Protection Mediated via Antibody-Dependent NK Cell Activity." *J. Immunol.* 172(2004):5598-5605.
Jones et al. "Replacing the Complementarity-Determining Regions in a Human Antibody With Those From a Mouse." *Nature.* 321(1986):522-525.
Keller et al. "Passive Immunity in Prevention and Treatment of Infectious Diseases." *Clin. Microbiol. Rev.* 13.4(2000):602-614.
Kim et al. "Localization of the Site of the Murine IgG1 Molecule That is Involved in Binding to the Murine Intestinal Fc Receptor." *Eur. J. Immunol.* 24(1994):2429-2434.
Köhler et al. "Continuous Cultures of Fused Cells Secreting Antibody of Predefined Specificity." *Nature.* 256(1975):495-497.
Kostelny et al. "Formation of a Bispecific Antibody by the Use of Leucine Zippers." *J. Immunol.* 148.5(1992):1547-1553.
Kroll et al. "A Multifunctional Prokaryotic Protein Expression System: Overproduction, Affinity Purification and Selective Detection." *DNA Cell Biol.* 12(1993):441-453.
Kyte et al. "A Simple Method for Displaying the Hydropathic Character of a Protein." *J. Mol. Biol.* 157.1(1982):105-132.
Lamb et al. "Identification of a Second Protein ($M_2$) Encoded by RNA Segment 7 of Influenza Virus." *Virol.* 112(1981):729-737.
Lefranc et al. "IMGT Unique Numbering for Immunoglobulin and T Cell Receptor Variable Domains and Ig Superfamily V-Like Domains." *Dev. Comp. Immunol.* 27.1(2003):55-77.
Lefranc et al. "IMGT, The International ImMunoGeneTics Database," *Nucl. Acids Res.* 27.1(1999):209-212.
Lefranc. "Unique Database Numbering System for Immunogenetic Analysis." *Immunol. Today.* 18.11(1997):509.
Lindmark et al. "Binding of Immunoglobulins to Protein A and Immunoglobulin Levels in Mammalian sera." *J. Immunol. Meth.* 62.10(1983):1-13.
Liu et al. "Eradication of Large Colon Tumor Xenografts by Targeted Delivery of Maytansinoids." *PNAS.* 93.16(1996):8618-8623.
Liu et al. "N-Terminus of M2 Protein Could Induce Antibodies With Inhibitory Activity Against Influenza Virus Replication." *FEMS Immunol. Med. Microbiol.* 35(2003):141-146.
Logan et al. "Adenovirus Tripartite Leader Sequence Enhances Translation of mRNAs Late After Infection." *PNAS.* 81.12(1984):3655-3659.
Lowy et al. "Isolation of Transforming DNA: Cloning the Hamster aprt Gene." *Cell.* 22.3(1980):817-823.
Luke et al. "Meta-Analysis: Convalescent Blood Products for Spanish Influenza Pneumonia: A Future H5N1 Treatment?" *Ann. Intern. Med.* 145.8(2006):599-609.
Macken et al. "The Value of a Database in Surveillance and Vaccine Selection." *International Congress Series.* 219(2001):103-106.
Maddox et al. "Elevated Serum Levels in Human Pregnancy of a Molecule Immunochemically Similar to Eosinophil Granule Major Basic Protein." *J. Exp. Med.* 158(1983):1211-1226.
Marks et al. "By-Passing Immunization: Human Antibodies from V-Gene Libraries Displayed on Phage." *J. Mol. Biol.* 222.3(1991):581-597.
Martin et al. "Irreversible Coupling of Immunoglobulin Fragments to Preformed Vesicles." *J. Biol. Chem.* 257.1(1982):286-288.
Massey. "Catalytic Antibodies Catching on." *Nature.* 328(1987):457-458.
Mather et al. "Culture of Testicular Cells in Hormone-Supplemented Serum-Free Medium." *Ann. N.Y. Acad. Sci.* 383(1982):44-68.
Mather. "Establishment and Characterization of Two Distinct Mouse Testicular Epithelial Cell Lines." *Biol. Reprod.* 23.1(1980):243-252.
Meyer et al. "Glycoprotein gp116 of Human Cytomegalovirus Contains Epitopes for Strain-Common and Strain-Specific Antibodies." *J. Gen. Virol.* 73(1992):2375-2383.
Milstein et al. "Hybrid Hybridomas and Their Use in Immunohistochemistry." *Nature.* 305(1983):537-540.
Morimoto et al. "Single-Step Purification of F(ab')$_2$ Fragments of Mouse Monoclonal Antibodies (Immunoglobulins G1) by Hydro-

(56) References Cited

OTHER PUBLICATIONS phobic Interaction High Performance Liquid Chromatography using TSKgel Phenyl-5PW." *J. Biochem. Biophys. Methods.* 24.1-2(1992):107-117.
Morrison et al. "Chimeric Human Antibody Molecules: Mouse Antigen-Binding Domains with Human Constant Region Domains." *PNAS.* 81.21(1984):6851-6855.
Morrison. "The Determination of the Exposed Proteins on Membranes by the Use of Lactoperoxidase." *Meth. Enzymol.* 3(1974):103-109.
Mozdzanowska et al. "Induction of Influenza Type A Virus-Specific Resistance by Immunization of Mice With a Synthetic Multiple Antigenic Peptide Vaccine That Contains Ectodomains of Matrix Protein 2." *Vaccine.* 21(2003):2616-2626.
Murakami et al. "Cell Cycle Regulation, Oncogenes, and Antineoplastic Drugs." *The Molecular Basis of Cancer.* Mendelsohn et al., eds. Philadelphia: WB Saunders. (1995)1-17.
Muster et al. "A Conserved Neutralizing Epitope on gp41 of Human Immunodeficiency Virus Type 1." *J. Virol.* 67.11(1993):6642-6647.
Myers et al. "Optimal Alignments in Linear Space." *CABIOS.* 4.1(1988):11-17.
Nakamura et al. "Virolysis and In Vitro Neutralization of HIV-1 by Humanized Monoclonal Antibody hNM-01." *Hybridoma.* 19.6(2000):427-434.
Navarro et al. "Humoral Immune Response to Functional Regions of Human Cytomegalovirus Glycoprotein B." *J. Med. Virol.* 52(1997):451-459.
Needleman et al. "A General Method Applicable to the Search for Similarities in the Amino Acid Sequence of Two Proteins." *J. Mol. Biol.* 48.3(1970):443-453.
Neirynck et al. "A Universal Influenza A Vaccine Based on the Extracellular Domain of the M2 Protein." *Nat. Med.* 5.10(1999):1157-1163.
Neuberger et al. "Recombinant Antibodies Possessing Novel Effctor Functions." *Nature.* 312(1984):604-608.
Neumann et al. "Emergence and Pandemic Potential of Swine-Origin H1N1 Influenza Virus." *Nature.* 459(2009):931-939.
Okuno et al. "A Common Neutralizing Epitope Conserved Between the Hemagglutinins of Influenza A Virus H1 and H2 Strains." *J. Virol.* 67.5(1993):2552-2558.
Pearson et al. "Improved Tools for Biological Sequence Comparison." *PNAS.* 85(1988):2444-2448.
Plückthun et al. "Expression of Functional Antibody Fv and Fab Fragments in *Escherichia coli.*" *Meth. Enzymol.* 178(1989):497-515.
Plückthun. "Antibodies from *Escherichia coli.*" *The Pharmacology of Monoclonal Activities.* Rosenburg et al., eds. New York: Springer-Verlag. 113(1994):269-315.
Porath. "Immobilized Metal Ion Affinity Chromatography." *Prot. Exp. Purif.* 3.4(1992):263-281.
Presta. "Antibody Engineering." *Curr. Op. Struct. Biol.* 2.4(1992):593-596.
Ravetch et al. "Fc Receptors." *Annu. Rev. Immunol.* 9(1991):457-492.
Rhodes et al. "Transformation of Maize by Electroporation of Embryos." *Methods Mol. Biol.* 55(1995):121-131.
Riechmann et al. "Reshaping Human Antibodies for Therapy." *Nature.* 332(1988):323-327.
Robinson. "Comparison of Label Tree with Valency Three." *J. Combin. Ther. Ser. B.* 11(1971):105-119.
Ruiz et al. "IMGT, The International ImMunoGeneTics Database." *Nucl. Acids Res.* 28.1(2000):219-221.
Russell et al. "The Global Circulation of Seasonal Influenza A (H3N2) Viruses." *Science.* 320(2008):340-346.
Saitou et al. "The Neighbor-Joining Method: A New Method for Reconstructing Phylogenetic Trees." *Mol. Biol. Evol.* 4.4(1987):406-425.
Sanger et al. "DNA Sequencing With Chain-Terminating Inhibitors." *PNAS.* 74.12(1977):5463-5467.
Scatchard et al. "The Attractions of Proteins for Small Molecules and Ions." *Ann. N.Y. Acad. Sci.* 51(1949):660-672.

Shalaby et al. "Development of Humanized Bispecific Antibodies Reactive with Cytotoxic Lumphocytes and Tumor Cells Overexpressing the HER2 Protooncogene." *J. Exp. Med.* 175(1992):217-225.
Shibata et al. "Neutralizing Antibody Directed Against the HIV-1 Envelope Glycoprotein Can Completely Block HIV-1/SIV Chimeric Virus Infections of Macaque Monkeys." *Nat. Med.* 5.2(1999):204-210.
Shopes. "A Genetically Engineered Human IgG Mutant with Enhanced Cytolytic Activity." *J. Immunol.* 148.9(1992):2918-2922.
Slepushkin et al. "Protection of Mice Against Influenza A Virus Challenge by Vaccination With Baculovirus-Expressed M2 Protein." *Vaccine.* 13(1995):1399-1402.
Smith et al. "Comparison of Biosequences." *Adv. Appl. Math.* 2.4(1981):482-489.
Stevens et al. "Structure and Receptor Specificity of the Hemagglutinin From an H5N1 Influenza Virus." *Science.* 312(2006):404-410.
Stevenson et al. "A Chimeric Antibody with Dual Fc Receptor Regions (bisFabFc) Prepared b Manipulations at the IgG Hinge." *Anti-Cancer Drug Des.* 2(10989):219-230.
Stites et al., ed. "Immunoglobulin Proteins." *Basic and Clinical Immunology.* Norwalk, CT: Appleton & Lange. 8th ed. (1994):66-79.
Sui et al. "Structural and Functional Bases for Broad-Spectrum Neutralization of Avian and Human Influenza A Viruses." *Nat. Struct. Mol. Biol.* 16.3(2009):265-273.
Suresh et al. "Bispecific Monoclonal Antibodies from Hybrid Hybridomas." *Meth. Enzymol.* 121(1986):210-228.
Syvanen et al. "Preparation of 125I-Catalytic Subunit of Aspartate Transcarbamylase and Its Use in Studies of the Regulatory Subunit." *J. Biol. Chem.* 248.11(1973):3762-3768.
Takamatsu et al. "Expression of Bacterial Chloramphenicol Acetyltransferase Gene in Tobacco Plants Mediated by TMV-RNA." *EMBO J.* 6.2(1987):307-311.
Thompson et al. "Influenza-Associated Hospitalizations in the United States." *JAMA.* 292.11(2004):1333-1340.
Throsby et al. "Heterosubtypic Neutralizing Monoclonal Antibodies Cross-Protective against H5N1 and H1N1 Recovered from Human IgM+ Memory B Cells." *PLoS One.* 3.12(2008):e3942.
Tompkins et al. "Matrix Protein 2 Vaccination and Protection against Influenza Viruses, Including Subtype H5N1." *Emerg. Infect. Dis.* 13.3(2007):426-435.
Traunecker et al. "Bispecific Single Chain Molecules (Janusins) Target Cytotoxic Lumphocytes on HIV Infected Cells." *EMBO J.* 10.12(1991):3655-3659.
Treanor et al. "Passively Transferred Monoclonal Antibody to the M2 Protein Inhibits Influenza A Virus Replication in Mice." *J. Virol.* 64.3(1990):1375-1357.
Tutt et al. "Trispecific F(ab')3 Derivatives that Use Cooperative Signaling via the TCR/CD3 Complex and CD2 to Activate and Redirect Resting Cytotoxic T Cells." *J. Immunol.* 147.1(1991):60-69.
Urlaub et al. "Isolation of Chinese Hamster Cell Mutants Deficient in Dihydrofolate Reductase Activity." *PNAS.* 77.7(1980):4216-4220.
Van Heeke et al. "Expression of Human Asparagine Synthetase in *Escherichia coli.*" *J. Biol. Chem.* 264.10(1989):5503-5509.
Verhoeyen et al. "Reshaping Human Antibodies: Grafting an Antilysozyme Activity." *Science.* 239(1988):1534-1536.
Vitetta et al. "Redesigning Nature's Poisons to Create Anti-Tumor Reagents." *Science.* 238(1987):1098-1104.
Walker et al. "Broad and Potent Neutralizing Antibodies from an African Donor Reveal a New HIV-1 Vaccine Target." *Science.* 326(2009):289-293.
Wang et al. "Ion Channel Activity of Influenza Virus $M_2$ Protein: Characterization of the Amantadine Block." *J. Virol.* 67.9(1993):5585-5594.
Wang et al. "Therapeutic Potential of a Fully Human Monoclonal Antibody Against Influenza A Virus M2 Protein." *Antiviral Res.* 80(2008):168-177.
Wigler et al. "Transfer of Purified Herpes Virus Thymidine Kinase Gene to Cultured Mouse Cells." *Cell.* 11.1(1977):223-232.
Wigler et al. "Transformation of Mammalian Cells with an Amplifiable Dominant-Acting Gene." *PNAS.* 77.6(1980):3567-3570.

(56) References Cited

OTHER PUBLICATIONS

Wilbur et al. "Rapid Similarity Searches of Nucleic Acid and Protein Data Banks." *PNAS.* 80.3(1983):726-730.

Winter et al. "The Expression of Heat Shock Protein and Cognate Genes During Plant Development." *Results Probl. Cell Differ.* 17(1991):85-105.

Wolff et al. "Monoclonal Antibody Homodimers: Enhanced Antitumor Activity in Nude Mice." *Cancer Res.* 53(1993):2560-2565.

Yaniv. "Enhancing Elements for Activation of Eukaryotic Promoters." *Nature.* 297(1982):17-18.

Zapata et al. "Engineering Linear F(ab')$_2$ Fragments for Efficient Production in *Escherichia coli* and Enhanced Antiproliferative Activity." *Protein Eng.* 8.10(1995):1057-1062.

Zebedee et al. "Influenza A Virus $M_2$ Protein: Monoclonal Antibody Restriction of Virus Growth and Detection of $M_2$ in Virions." *J. Virol.* 62.8(1988):2762-2772.

Zharikova et al. "Influenza Type A Virus Escape Mutants Emerge In Vivo in the Presence of Antibodies to the Ectodomain of Matrix Protein 2." *J. Virol.* 79.11(2005):6644-6654.

Crisci et al. "Chimeric Calicivirus-Like Particles Elicit Protective Anti-Viral Cytotoxic Responses Without Adjuvant." *Virol.* 387.2(2009):303-312.

Grgacic et al. "Virus-Like Particles: Passport to Immune Recognition." *Methods.* 40.1(2006):60-65.

Jennings et al. "The Coming of Age of Virus-Like Particle Vaccines." *Biol. Chem.* 389.5(2008):521-536.

\* cited by examiner

FIG. 3A

FULL-LENGTH M2 VARIANT BINDING
AMINO ACID SEQUENCES OF EXTRACELLULAR DOMAINS OF M2 VARIANTS.

| SEQ ID: No: | | | | | | | | | 10 | | | | | | | | 20 | | | | | | |
|---|---|---|---|---|---|---|---|---|---|---|---|---|---|---|---|---|---|---|---|---|---|---|---|
| 1 A.Brevig Mission.1.1918.H1N1 | M | S | L | L | T | E | V | E | T | P | T | R | N | E | W | G | C | R | C | N | D | S | S | D |
| 2 A.Fort Monmouth.1.1947.H1N1 | M | S | L | L | T | E | V | E | T | P | T | K | N | E | W | E | C | R | C | N | D | S | S | D |
| 3 A.Singapore.02.2005.H3N2 | M | S | L | L | T | E | V | E | T | P | I | R | N | E | W | E | C | R | C | N | D | S | S | D |
| 679 A.Wisconsin.10.98.H1N1 | M | S | L | L | T | E | V | E | T | P | I | K | N | G | W | E | C | K | C | N | D | S | S | D |
| 5 A.Wisconsin.301.1976.H1N1 | M | S | L | L | T | E | V | E | T | P | I | R | S | E | W | G | C | R | C | N | D | S | S | D |
| 6 A.Panama.1.66.H2N2 | M | S | F | L | P | E | V | E | T | P | I | R | N | E | W | G | C | R | C | N | D | S | S | D |
| 7 A.New York.321.1999.H3N2 | M | S | L | L | T | E | V | E | T | P | I | R | N | E | W | G | C | R | C | N | D | S | S | N |
| 8 A.Caracas.1.71.H3N2 | M | S | L | L | T | E | V | E | T | P | I | R | K | E | W | G | C | R | C | N | D | S | S | D |
| 9 A.Taiwan.3.71.H3N2 | M | S | F | L | T | E | V | E | T | P | I | R | N | E | W | G | C | R | C | N | D | S | S | D |
| 10 A.Wuhan.359.95.H3N2 | M | S | L | P | T | E | V | E | T | P | I | R | S | E | W | G | C | R | C | N | D | S | S | D |
| 11 A.Hong Kong.1144.99.H3N2 | M | S | L | L | P | E | V | E | T | P | I | R | N | E | W | G | C | R | C | N | D | S | S | D |
| 12 A.Hong Kong.1180.99 H3N2 | M | S | L | L | P | E | V | E | T | P | I | R | N | G | W | G | C | R | C | N | D | S | S | D |
| 13 A.Hong Kong.1774.99 H3N2 | M | S | L | L | T | E | V | E | T | P | T | R | N | G | W | E | C | R | C | S | G | S | S | D |
| 14 A.New York.217.02 H1N2 | M | S | L | L | T | E | V | E | T | P | I | R | N | E | W | E | Y | R | C | N | D | S | S | D |
| 15 A.New York.300.2003.H1N2 | M | S | L | L | T | E | V | E | T | P | I | R | N | E | W | E | Y | R | C | S | D | S | S | D |
| 16 A.swine.Spain.54008.2004.H3N2 | M | S | L | L | T | E | V | E | T | P | T | R | N | G | W | E | C | R | Y | S | D | S | S | D |
| 17 A.Guangzhou.333.99.H9N2 | M | S | F | L | T | E | V | E | T | L | T | R | N | G | W | E | C | R | C | S | D | S | S | D |
| 18 A.Hong Kong.1073.99.H9N2 | M | S | L | L | T | E | V | E | T | L | T | R | N | G | W | E | C | K | C | R | D | S | S | D |
| 19 A.Hong Kong.1.68.H3N2 | M | S | L | L | T | E | V | E | T | P | I | R | N | E | W | G | C | R | C | N | D | S | S | D |
| 20 A.swine.Hong Kong.126.1982.H3N2 | M | S | L | L | T | E | V | E | T | P | I | R | S | E | W | G | C | R | C | N | D | S | G | D |
| 21 A.New York.703.1995.H3N2 | M | S | L | L | T | E | V | E | T | P | I | R | N | E | W | E | C | R | C | N | G | S | S | D |
| 22 A.swine.Quebec.192.81 H1N1 | M | S | L | P | T | E | V | E | T | P | I | R | N | E | W | G | C | R | C | N | D | S | S | D |
| 23 A.Puerto Rico.8.34.H1N1 | M | S | L | L | T | E | V | E | T | P | I | R | N | E | W | G | C | R | C | N | G | S | S | D |
| 24 A.Hong Kong.485.97.H5N1 | M | S | L | L | T | E | V | D | T | L | T | R | N | G | W | G | C | R | C | S | D | S | S | D |
| 25 A.Hong Kong.542.97.H5N1 | M | S | L | L | T | E | V | E | T | L | T | K | N | G | W | G | C | R | C | S | D | S | S | D |
| 26 A.silky chicken.Shantou.1826.2004.H | M | S | L | L | T | E | V | E | T | P | T | R | N | G | W | E | C | K | C | S | D | S | S | D |
| 27 A.chicken.Taiwan.0305.04.H6N1 | M | S | L | L | T | E | V | E | T | H | T | R | N | G | W | E | C | K | C | S | D | S | S | D |
| 28 A.Quail.Arkansas.16309-7.94.H7N3 | M | S | L | L | T | E | V | K | T | P | T | R | N | G | W | E | C | K | C | S | D | S | S | D |
| 29 A.Hong Kong.486.97.H5N1 | M | S | L | L | T | E | V | E | T | L | T | R | N | G | W | G | C | R | C | S | D | S | S | D |
| 30 A.Chicken.Pennsylvania.13552-1.98 | M | S | L | L | T | E | V | E | T | P | T | R | D | G | W | E | C | K | C | S | D | S | S | D |
| 31 A.chicken.Heilongjiang.48.01.H9N2 | M | S | L | L | T | E | V | E | T | P | T | R | N | G | W | E | C | R | C | S | D | S | S | D |
| 32 A.swine.Korea.S5.2005.H1N2 | M | S | L | L | T | E | V | E | T | P | T | R | N | G | W | E | C | K | C | N | D | S | S | D |
| 33 A.Hong Kong.1073.99.H9N2 | M | S | L | L | T | E | V | E | T | L | T | R | N | G | W | E | C | K | C | S | D | S | S | D |
| 34 A.Wisconsin.3523.88.H1N1 | M | S | L | L | T | E | V | E | T | P | I | R | N | E | W | G | C | K | C | N | D | S | S | D |
| 35 A.X-31 Vaccine strain H3N2 | M | S | F | L | T | E | V | E | T | P | I | R | N | E | W | G | C | R | C | N | G | S | S | D |
| 36 A.Chicken.Rostock.8.1934.H7N1 | M | S | L | L | T | E | V | E | T | P | T | R | N | G | W | E | C | R | C | N | D | S | S | D |
| 37 A.environment.New York. 16326-1.2 | M | S | L | L | T | E | V | E | T | P | I | R | K | G | W | E | C | N | C | S | D | S | S | D |
| 38 A.Indonesia.560H.2006.H5N1 | M | S | L | L | T | E | V | E | T | P | T | R | N | E | W | E | C | R | C | S | D | S | S | D |
| 39 A.Chicken.Hong Kong.SF1.03.H9N2 | M | S | L | L | T | G | V | E | T | H | T | R | N | G | W | G | C | K | C | S | D | S | S | D |
| 40 A.chicken.Hong Kong YU427.03.H9N | M | S | L | L | P | E | V | E | T | H | T | R | N | G | W | G | C | R | C | S | D | S | S | D |

EXTRACELLULAR SEQUENCE OF D20 IS IDENTICAL
TO #19, HK483 TO #29, AND VN1203 TO #38.

CROSS REACTIVITY BINDING OF ANTI-M2 ANTIBODIES TO VARIANT M2 PEPTIDES

| seqNo | Name | Size | Description | ELISA (OD 450) | | | |
|---|---|---|---|---|---|---|---|
| | | | | 14C2 | 8i10 | 23K12 | 2N9 |
| 680 | M2 | 23 aa | SLLTEVETPIRNEWGCRCNDSSD | + | - | - | - |
| 681 | M2SG | 23 aa | SLLTEVETPIRSEWGCRCNDSGD | + | - | - | - |
| 682 | M2EG | 23 aa | SLLTEVETPIRNEWECRCNGSSD | + | - | - | - |
| 683 | M2P | 23 aa | SLPTEVETPIRNEWGCRCNDSSD | + | - | - | - |
| 684 | M2G | 23 aa | SLLTEVETPIRNEWGCRCNGSSD | + | - | - | - |
| 685 | M2DLTGS | 23 aa | SLLTEVDTLTRNGWGCRCSDSSD | - | - | + | - |
| 686 | M2KNS | 23 aa | SLLTEVETPIRKEWGCNCSDSSD | + | - | - | - |
| 687 | M2LGS | 23 aa | SLLTEVETLIRNGWGCRCSDSSD | - | - | - | - |
| 688 | M2LTKGS | 23 aa | SLLTEVETLTKNGWGCRCSDSSD | - | - | - | - |
| 689 | M2SY | 23 aa | SLLTEVETPIRSEWGCRYNDSSD | + | - | - | - |
| 690 | M2TGEKS | 23 aa | SLLTEVETPTRNGWECKCSDSSD | + | - | - | - |
| 691 | M2HTGEKS | 23 aa | SLLTEVETHTRNGWECKCSDSSD | - | - | - | - |
| 692 | M2KTGEKS | 23 aa | SLLTEVKTPTRNGWECKCSDSSD | - | - | - | - |
| 693 | M2LTGS | 23 aa | SLLTEVETLTRNGWGCRCSDSSD | - | - | + | - |
| 694 | M2TDGEKS | 23 aa | SLLTEVETPTRDGWECKCSDSSD | + | - | - | - |
| 695 | M2TGS | 23 aa | SLLTEVETPTRNGWGCRCSDSSD | + | - | W | - |
| 696 | M2TGEK | 23 aa | SLLTEVETPTRNGWECKCNDSSD | + | - | - | - |
| 697 | M2LTGEKS | 23 aa | SLLTEVETLTRNGWECKCSDSSD | - | - | W | - |
| 698 | M2K | 23 aa | SLLTEVETPIRNEWGCKCNDSSD | + | W | + | - |
| 699 | M2FG | 23 aa | SFLTEVETPIRNEWGCRCNGSSD | + | W | - | - |
| 700 | M2TGE | 23 aa | SLLTEVETPTRNGWECRCNDSSD | + | - | - | - |
| 701 | M2KGENS | 23 aa | SLLTEVETPIRKGWECNCSDSSD | + | - | - | - |
| 702 | M2TES | 23 aa | SLLTEVETPTRNEWECRCSDSSD | + | - | - | - |
| 703 | M2GHTGKS | 23 aa | SLLTGVETHTRNGWGCKCSDSSD | - | - | - | - |
| 704 | M2PHTGS | 23 aa | SLLPEVETHTRNGWGCRCSDSSD | - | - | - | - |

PERCENTAGE COMPARED RELATIVE TO BINDING TO WILD-TYPE PEPTIDE (Seq 1)   NOTE: mAbs WERE TESTED AT 5 μg/mL

> 25 %      -      NO BINDING
25 - 40 %   W      WEAK BINDING
> 40 %      +      POSITIVE BINDING

FIG. 6A

BINDING ACTIVITY OF M2 ANTIBODIES TO TRUNCATED M2 PEPTIDES

| seqNo | Name | Size | Description | 14C2 | 8i10 | 23K12 | 2N9 |
|---|---|---|---|---|---|---|---|
| 680 | M2 | 23 aa | SLLTEVETPIRNEWGCRCNDSSD | 3.85 | 0.11 | 0.22 | 0.06 |
| 705 | M16 | 16 aa | LLTEVETPIRNEWGCR | 3.94 | 0.09 | 0.21 | 0.09 |
| 706 | M15 | 15 aa | LTEVETPIRNEWGCR | 3.95 | 0.09 | 0.21 | 0.09 |
| 707 | M12 | 12 aa | VETPIRNEWGCR | 0.15 | 0.09 | 0.20 | 0.09 |
| 708 | CM17 | 17 aa | ETPIRNEWGCRCNDSSD | 0.19 | 0.11 | 0.34 | 0.11 |
| 709 | CM16 | 16 aa | TPIRNEWGCRCNDSSD | 0.23 | 0.13 | 0.35 | 0.12 |
| 710 | CM15 | 15 aa | PIRNEWGCRCNDSSD | 0.19 | 0.12 | 0.34 | 0.11 |
| 711 | CM14 | 14 aa | IRNEWGCRCNDSSD | 0.23 | 0.14 | 0.36 | 0.13 |
| 712 | CM13 | 13 aa | RNEWGCRCNDSSD | 0.22 | 0.14 | 0.34 | 0.13 |
| 713 | CM12 | 12 aa | NEWGCRCNDSSD | 0.27 | 0.14 | 0.39 | 0.14 |
| 714 | NM17 | 17 aa | SLLTEVETPIRNEWGCR | 3.99 | 0.26 | 0.58 | 0.10 |
| 715 | NM16 | 16 aa | SLLTEVETPIRNEWGC | 3.90 | 0.29 | 0.62 | 0.09 |
| 716 | NM15 | 15 aa | SLLTEVETPIRNEWG | 3.97 | 0.12 | 0.30 | 0.11 |
| 717 | NM14 | 14 aa | SLLTEVETPIRNEW | 3.97 | 0.11 | 0.24 | 0.09 |
| 718 | NM13 | 13 aa | SLLTEVETPIRNE | 0.18 | 0.11 | 0.25 | 0.10 |
| 719 | NM12 | 12 aa | SLLTEVETPIRN | 0.20 | 0.10 | 0.24 | 0.09 |
| 720 | NM11 | 11 aa | SLLTEVETPIR | 0.21 | 0.13 | 0.30 | 0.12 |
| 721 | NM10 | 10 aa | SLLTEVETPI | 0.17 | 0.10 | 0.24 | 0.10 |
| 722 | NM8 | 8 aa | SLLTEVET | 0.15 | 0.10 | 0.20 | 0.09 |
| 723 | NM7 | 7 aa | SLLTEVE | 0.14 | 0.10 | 0.20 | 0.08 |
| 724 | NM9 | 9 aa | SLLTEVETP | 0.21 | 0.12 | 0.30 | 0.19 |
| 19 | M2e | 24 aa | MSLLTEVETPIRNEWGCRCNDSSD | 3.98 | 0.13 | 0.43 | 0.10 |
| CMV | HVIR1 | | | 0.16 | 0.11 | 0.21 | 3.99 |

NOTE: mAbs WERE TESTED AT 5 μg/mL

FIG. 6B

HIGH PATH PROPHYLACTIC IN VIVO STUDY
VN 1203/04 SURVIVAL

- ◆ 23K12
- □ 14C2
- ▲ 2N9 (ISOTYPE MATCHED CONTROL)
- ✕ 8i10

X-axis: DAYS POST INFECTION (0–28)
Y-axis: PERCENT SURVIVAL (0–100)

FIG. 7

FIG. 12A
Heavy Chain

FIG. 12A (continued)

FIG. 12B
Kappa Chain

FIG. 12B (continued)

| | FR3 | | | | | | | | | | | | | | | | | | | | | | | | | | | | CDR3 | | | | | | | | | FR4 | | | | | | | | | | Kappa joining segment |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|
| Germline Vkappa 1-39*01 | F | S | G | S | G | S | G | T | D | F | T | L | T | I | I | S | S | L | Q | P | E | D | F | A | T | Y | Y | C | Q | Q | S | Y | S | T | P | L | T | F | G | G | G | T | R | V | E | I | K | |
| TCN-032 | | | | | | | | | | | | | | | | | | | | | | | | | | | | | | | | | | | | | | | | | | | | | | | | KJ4*01 |
| 43J7 | | | | | | | T | | | | | | | | | | | | | | | | | | | | | | | | | | | | P | | | | | | | | | K | | | | KJ2*01 or KJ2*02 or KJ2*03 or KJ2*04 |
| 53P10 | | S | | | | | | | | | | | | | | | | | | | | | | | | | | | | | N | | | | | | | | | Q | | | | K | L | | | KJ2*01 or KJ2*02 or KJ2*03 or KJ2*04 |
| 44I10 | A | | | | | | | | | | | | | | | | | | | | | | | | | | | | | | N | | | | | | | | | Q | | | | K | L | | | KJ2*01 or KJ2*02 or KJ2*03 or KJ2*04 |
| 55J6 | A | | | | | | | | | | | | | | | | | | | | | | | | | | | | | | N | | | | | | | | | Q | | | | | L | | | KJ5*01 |
| 52C13 | | | | | | | G | | | | | | | | | | | | | | | | | | | | | | | | N | | | | | | | | | P | | | | | L | | | KJ5*01 |
| 39P23 | | | | | | | | | | | | | | | | | | | | | | D | | S | | | | F | | | N | | | | | | | | | Q | | | | | L | | | KJ1*01 |
| 36G5 | | | | | R | | | | | | | | | T | N | I | | | T | | | | | | | | | | | | | | | | P | A | | | | Q | | | | K | D | M | | KJ3*01 |
| 48P18 | | | | | | | | | | | | | | | | | | | | | | | | S | | | | L | | | | | | | | V | A | | | P | | | | K | | V | | KJ4*01 |
| 59J21 | A | | | | | | | | | | | | | | | | | | | | | | | | | | | | | | | | | | | V | A | | | | | | | K | | | | KJ4*01 |
| 20I23 | | | | | | | | | | | | | | | | | | | G | | | | | | | | | L | | | | | | | P | | | | | | | | | | L | | | KJ5*01 |
| 62B11 | | | | | | | | | | | | | | | | | | | G | | | | | | | | | F | | | | | | | | A | | | | Q | | | | | L | | | KJ5*01 |
| 41G23 | | | | | | | | | | | | | | | | | | | | | | | | A | | | | | | | | | | | | A | | | | Q | | | | | L | | | KJ5*01 |
| 23K12 | | | | | | | | | | | | | | | | | | | | | | | | | | | | | T | | | | | | | M | | | | Q | | | | K | L | | | KJ2*01 or KJ2*02 |
| 44H4 | | | | | | | | | | | | | | | | | | | | | | | | S | | | | | | | T | | | | | | | | | Q | | | | | L | | | KJ5*01 |
| 45O19 | | | | | | | | | | | | | | | | | | | | | | | | S | | | | | | | T | | | | | | | | | Q | | | | | L | | | KJ5*01 |
| 60D19 | T | | | | | | | | | | | | | | | | E | | | | | | | | | | | | | | T F | | | | | | | | | Q | | | | K | L | | | KJ2*01 or KJ2*02 or KJ2*03 or KJ2*04 (a) |

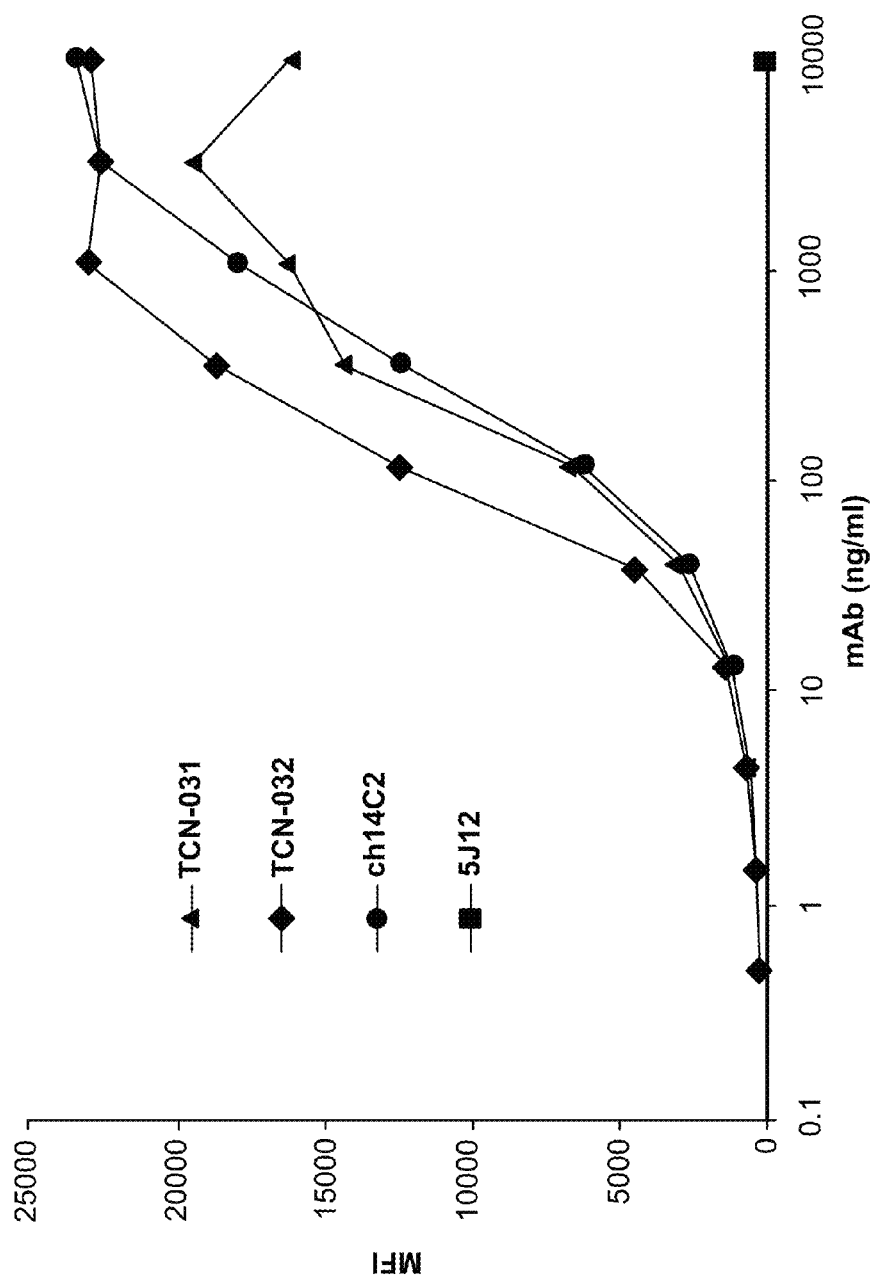

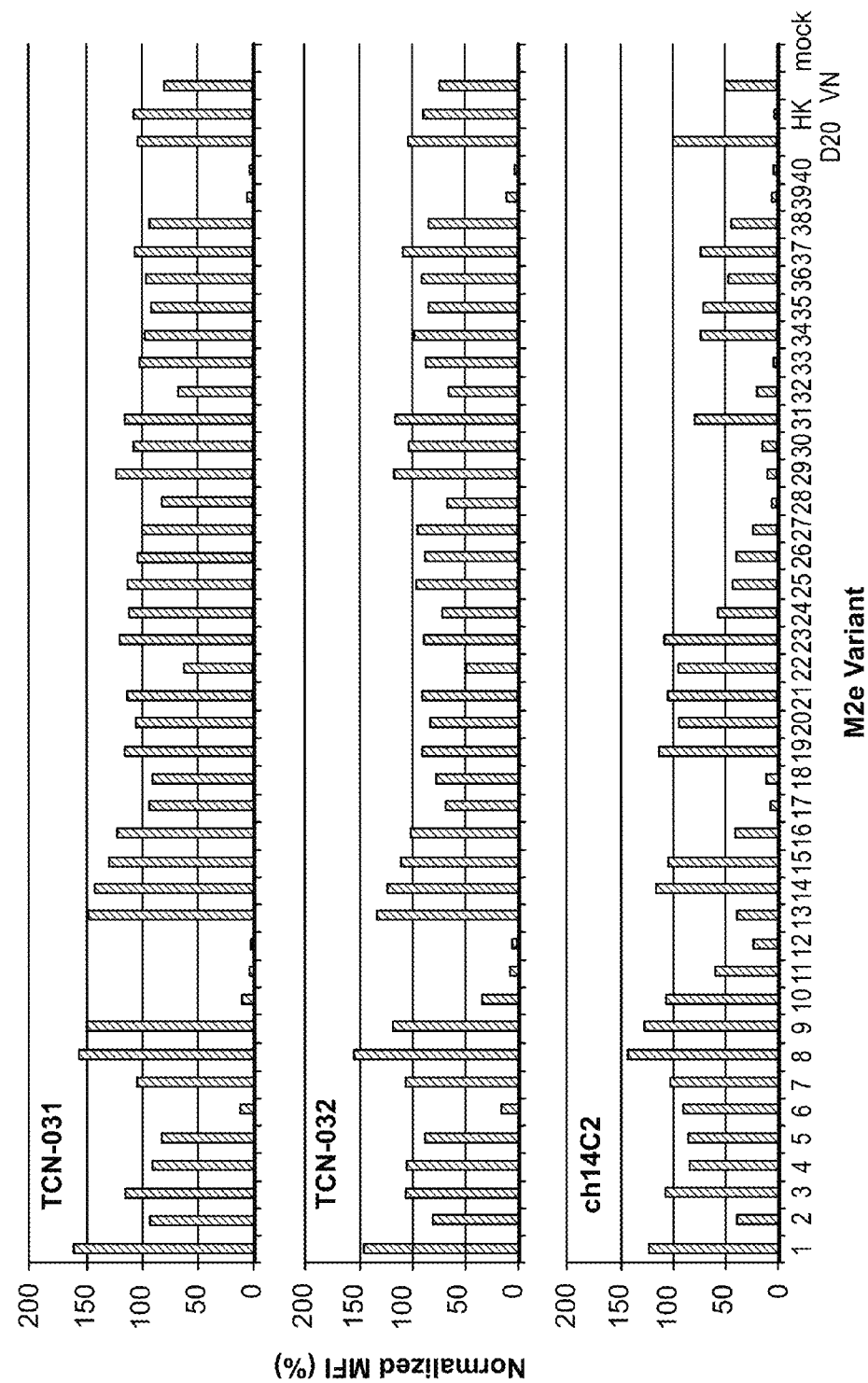

US 8,916,160 B2

COMPOSITIONS AND METHODS FOR THE THERAPY AND DIAGNOSIS OF INFLUENZA

RELATED APPLICATIONS

This application claims the benefit of provisional application U.S. Ser. No. 61/442,733, filed Feb. 14, 2011, the contents of which are herein incorporated by reference in their entirety.

INCORPORATION OF SEQUENCE LISTING

The contents of the text file named "37418-518001US_ST25.txt," which was created on Jan. 6, 2012 and is 910 KB in size, are hereby incorporated by reference in their entirety.

FIELD OF THE INVENTION

The present invention relates generally to prevention, diagnosis, therapy and monitoring of influenza infection. The invention is more specifically related to compositions containing a combination of human antibodies raised against either the influenza hemagglutinin or matrix 2 protein. Such compositions are useful in pharmaceutical compositions for the prevention and treatment of influenza, and for the diagnosis and monitoring of influenza infection.

BACKGROUND OF THE INVENTION

Influenza virus infects 5-20% of the population and results in 30,000-50,000 deaths each year in the U.S. Disease caused by influenza A viral infections is typified by its cyclical nature. Antigenic drift and shift allow for different A strains to emerge every year. Added to that, the threat of highly pathogenic strains entering into the general population has stressed the need for novel therapies for flu infections.

SUMMARY OF THE INVENTION

The invention provides diagnostic, prophylactic, and therapeutic compositions including a human antibody raised against the Influenza hemagglutinin protein and a human monoclonal antibody raised against the Influenza M2 protein. Moreover, the invention provides diagnostic, prophylactic, and therapeutic compositions including an isolated human antibody raised against an epitope of the Influenza hemagglutinin protein and an isolated human monoclonal antibody raised against an epitope of the Influenza M2 protein. Furthermore, these compositions are pharmaceutical compositions that include a pharmaceutical carrier. These compositions address a long-felt need in the art for pharmaceutical compositions that both strongly neutralizes Influenza virus infection and recognizes constant regions within proteins common to all Influenza strains.

Specifically, the invention provides a composition including: (a) an isolated human antibody that specifically binds to an epitope of the hemagglutinin (HA) glycoprotein of an influenza virus; and (b) an isolated human monoclonal antibody that specifically binds to an epitope in the extracellular domain of the matrix 2 ectodomain (M2e) polypeptide of an influenza virus. In certain embodiments of this composition, the isolated human monoclonal antibody that specifically binds an epitope of the M2e polypeptide is TCN-032 (8I10), 21B15, TCN-031 (23K12), 3241_G23, 3244_I10, 3243_J07, 3259_J21, 3245_O19, 3244_H04, 3136_G05, 3252_C13, 3255_J06, 3420_I23, 3139_P23, 3248_P18, 3253_P10, 3260_D19, 3362_B11, or 3242_P05. Moreover, the isolated human antibody that specifically binds an epitope of the HA glycoprotein is optionally TCN-522 (3212_I12), TCN-521 (3280_D18), TCN-523 (5248_A17), TCN-563 (5237_B21), TCN-526 (5084_C17), TCN-527 (5086_C06), TCN-528 (5087_P17), TCN-529 (5297_H01), TCN-530 (5248_H10), TCN-531 (5091_H13), TCN-532 (5262_H18), TCN-533 (5256_A17), TCN-534 (5249_B02), TCN-535 (5246_P19), TCN-536 (5095_N01), TCN-537 (3194_D21), TCN-538 (3206_O17), TCN-539 (5056_A08), TCN-540 (5060_F05), TCN-541 (5062_M11), TCN-542 (5079_A16), TCN-543 (5081_G23), TCN-544 (5082_A19), TCN-545 (5082_I15), TCN-546 (5089_L08), TCN-547 (5092_F11), TCN-548 (5092_P01), TCN-549 (5092_P04), TCN-550 (5096_F06), TCN-551 (5243_D01), TCN-552 (5249_I23), TCN-553 (5261_C18), TCN-554 (5277_M05), TCN-555 (5246_L16), TCN-556 (5089_K12), TCN-557 (5081_A04), TCN 558 (5248_H10b), TCN-559 (5097_G08), TCN-560 (5084_P10), TCN-504 (3251_K17), SC06-141, SC06-255, SC06-257, SC06-260, SC06-261, SC06-262, SC06-268, SC06-272, SC06-296, SC06-301, SC06-307, SC06-310, SC06-314, SC06-323, SC06-325, SC06-327, SC06-328, SC06-329, SC06-331, SC06-332, SC06-334, SC06-336, SC06-339, SC06-342, SC06-343, SC06-344, CR6141, CR6255, CR6257, CR6260, CR6261, CR6262, CR6268, CR6272, CR6296, CR6301, CR6307, CR6310, CR6314, CR6323, CR6325, CR6327, CR6328, CR6329, CR6331, CR6332, CR6334, CR6336, CR6339, CR6342, CR6343, CR6344, 2A, D7, D8, F10, G17, H40, A66, D80, E88, E90, or H98.

The epitope of the HA glycoprotein is optionally GVT-NKVNSIIDK (SEQ ID NO: 198), GVTNKVNSIINK (SEQ ID NO: 283), GVTNKENSIIDK (SEQ ID NO: 202), GVT-NKVNRIIDK (SEQ ID NO: 201), GITNKVNSVIEK (SEQ ID NO: 281), GITNKENSVIEK (SEQ ID NO: 257), GIT-NKVNSIIDK (SEQ ID NO: 225), and KITSKVNNIVDK (SEQ ID NO: 216). The influenza hemaglutinin (HA) glycoprotein includes an HA1 and HA2 subunit. Exemplary epitopes of the HA glycoprotein include the HA1 subunit, HA2 subunit, or both the HA1 and HA2 subunits. Alternatively, or in addition, the epitope of the M2e polypeptide is a discontinuous epitope. For example, the epitope of the M2e polypeptide includes the amino acid at positions 2, 5, and 6 of MSLLTEVETPTRNEWGCRCNDSSD (SEQ ID NO: 1) or the amino acid at positions 2, 5, and 6 of SLLTEV (SEQ ID NO: 42).

The invention further provides a composition including: (a) an isolated human anti-HA antibody, or an antigen-binding fragment thereof, including a heavy chain variable region (VH) domain and a light chain variable (VL) domain, wherein the VH domain and the VL domain each contain three complementarity determining regions 1 to 3 (CDR1-3), and wherein each CDR includes the following amino acid sequences: VH CDR1: SEQ ID NOs: 247, 571, 586, 597, 603, 609, 615, 627, 633, 637, 643, 649, 658, 664, 670, 303, 251, 242, or 222; VH CDR2: SEQ ID NOs: 248, 572, 587, 592, 598, 604, 610, 616, 628, 634, 638, 644, 650, 655, 659, 665, 671, 306, 249, 307, or 221; VH CDR3: SEQ ID NOs: 568, 573, 588, 593, 599, 605, 611, 617, 629, 635, 639, 645, 651, 656, 660, 666, 672, 725, 246, 290, or 220; VL CDR1: SEQ ID NOs: 569, 574, 577, 580, 583, 589, 594, 612, 618, 621, 624, 640, 646, 652, 661, 667, 285, 289, 245, 224, or 219; VL CDR2: SEQ ID NOs: 570, 575, 578, 581, 584, 590, 595, 601, 607, 613, 619, 622, 625, 631, 653, 662, 668, 305, 223, or 231;VL CDR3: SEQ ID NOs: 289, 576, 579, 582, 585, 591, 596, 602, 608, 614, 620, 623, 626, 632, 636, 642, 648, 654, 657, 663, 669, 308, 250, 227, or 280; and (b) an isolated anti-matrix 2 ectodomain (M2e) antibody, or antigen-binding fragment thereof, including a heavy chain variable (VH) domain and a light chain variable (VL) domain, wherein the VH domain and the VL domain each contain three complementarity determining regions 1 to 3 (CDR1-3), and wherein each CDR includes the following amino acid sequences: VH CDR1: SEQ ID NOs: 72, 103, 179, 187, 203, 211, 228, 252, 260, 268, 284, 293, or 301; VH CDR2: SEQ ID NOs: 74, 105, 180, 188, 204, 212, 229, 237, 253, 261, 269, 285, or 294; VH CDR3 SEQ ID NOs: 76, 107, 181, 189, 197, 205, 213, 230, 238, 254, 262, 270, 286, or 295; VL CDR1: SEQ ID NOs: 59, 92, 184, 192, 208, 192, 233, 241, 265, or 273; VL CDR2: SEQ ID NOs: 61, 94, 185, 193, 209, 217, 226, 234, 258, 274, or 282; and VL CDR3: SEQ ID NOs: 63, 96, 186, 194, 210, 218, 243, 259, 267, 275, 291, or 300.

Alternatively, or in addition, the invention provides a composition including: (a) an isolated human anti-HA antibody, or an antigen-binding fragment thereof, including a heavy chain variable region (VH) domain and a light chain variable (VL) domain, wherein the VH domain and the VL domain each contain three complementarity determining regions 1 to 3 (CDR1-3), and wherein each CDR includes the following amino acid sequences: VH CDR1: SEQ ID NOs: 247, 571, 586, 597, 603, 609, 615, 627, 633, 637, 643, 649, 658, 664, 670, 303, 251, 242, or 222; VH CDR2: SEQ ID NOs: 248, 572, 587, 592, 598, 604, 610, 616, 628, 634, 638, 644, 650, 655, 659, 665, 671, 306, 249, 307, or 221; VH CDR3: SEQ ID NOs: 568, 573, 588, 593, 599, 605, 611, 617, 629, 635, 639, 645, 651, 656, 660, 666, 672, 725, 246, 290, or 220; VL CDR1: SEQ ID NOs: 569, 574, 577, 580, 583, 589, 594, 612, 618, 621, 624, 640, 646, 652, 661, 667, 285, 289, 245, 224, or 219; VL CDR2: SEQ ID NOs: 570, 575, 578, 581, 584, 590, 595, 601, 607, 613, 619, 622, 625, 631, 653, 662, 668, 305, 223, or 231; VL CDR3: SEQ ID NOs: 289, 576, 579, 582, 585, 591, 596, 602, 608, 614, 620, 623, 626, 632, 636, 642, 648, 654, 657, 663, 669, 308, 250, 227, or 280; and (b) an isolated anti-matrix 2 ectodomain (M2e) antibody, or antigen-binding fragment thereof, including a heavy chain variable (VH) domain and a light chain variable (VL) domain, wherein the VH domain and the VL domain each contain three complementarity determining regions 1 to 3 (CDR1-3), and wherein each CDR includes the following amino acid sequences: VH CDR1: SEQ ID NOs: 109, 112, 182, 190, 206, 214, 239, 255, 263, 271, 287, 296, or 304; VH CDR2: SEQ ID NOs: 110, 113, 183, 191, 207, 215, 232, 240, 256, 264, 272, 288, or 297; VH CDR3 SEQ ID NOs: 76, 107, 181, 189, 197, 205, 213, 230, 238, 254, 262, 270, 286, or 295; VL CDR1: SEQ ID NOs: 59, 92, 184, 192, 208, 192, 233, 241, 265, or 273; VL CDR2: SEQ ID NOs: 61, 94, 185, 193, 209, 217, 226, 234, 258, 274, or 282; and VL CDR3: SEQ ID NOs: 63, 96, 186, 194, 210, 218, 243, 259, 267, 275, 291, or 300.

The invention provides a composition including: (a) an isolated human anti-HA antibody, or an antigen-binding fragment thereof, including a heavy chain variable region (VH) domain, wherein the VH domain includes the following amino acid sequences: SEQ ID NOs 309, 313, 317, 321, 325, 329, 333, 337, 341, 345, 349, 353, 357, 361, 365, 369, 373, 377, 381, 385, 389, 393, 397, 401, 405, 409, 199, 417, 423, 429, 435, 441, 447, 453, 459, 465, 471, 477, 483, 489, 495, 501, 507, 513, 519, 525, 531, 537, 543, 550, 556, or 562, and a light chain variable (VL) domain, wherein the VL domain includes the following amino acid sequences: SEQ ID NOs 310, 314, 318, 322, 326, 330, 334, 338, 342, 346, 350, 354, 358, 362, 366, 370, 374, 378, 382, 386, 390, 394, 398, 402, 406, 410, 414, 420, 426, 432, 438, 444, 450, 456, 462, 468, 474, 480, 486, 492, 498, 504, 510, 516, 522, 528, 534, 540, 547, 553, 559, or 565; and (b) an isolated anti-matrix 2 ectodomain (M2e) antibody, or antigen-binding fragment thereof, including a heavy chain variable (VH) domain, wherein the VH domain includes the following amino acid sequences: SEQ ID NOs 44, 277, 276, 50, 236, 235, 116, 120, 124, 128, 132, 136, 140, 144, 148, 152, 156, 160, 164, 168, 172, or 176, and a light chain variable (VL) domain, wherein the VL domain includes the following amino acid sequences: SEQ ID NOs 46, 292, 52, 118, 122, 126, 130, 134, 138, 142, 146, 150, 154, 158, 162, 166, 170, or 178.

Furthermore, the invention provides a multivalent vaccine composition including any of the compositions described herein containing an isolated human anti-HA antibody, or an antigen-binding fragment thereof and an isolated anti-matrix 2 ectodomain (M2e) antibody, or antigen-binding fragment thereof. Alternatively, the multivalent vaccine includes antibodies that bind to the epitopes to which the antibodies of the invention bind. Exemplary antibodies of the invention include, but are not limited to, TCN-032 (8I10), 21B15, TCN-031 (23K12), 3241_G23, 3244_I10, 3243_J07, 3259_J21, 3245_O19, 3244_H04, 3136_G05, 3252_C13, 3255_J06, 3420_I23, 3139_P23, 3248_P18, 3253_P10, 3260_D19, 3362_B11, 3242_P05, TCN-522 (3212_I12), TCN-521 (3280_D18), TCN-523 (5248_A17), TCN-563 (5237_B21), TCN-526 (5084_C17), TCN-527 (5086_C06), TCN-528 (5087_P17), TCN-529 (5297_H01), TCN-530 (5248_H10), TCN-531 (5091_H13), TCN-532 (5262_H18), TCN-533 (5256_A17), TCN-534 (5249_B02), TCN-535 (5246_P19), TCN-536 (5095_N01), TCN-537 (3194_D21), TCN-538 (3206_O17), TCN-539 (5056_A08), TCN-540 (5060_F05), TCN-541 (5062_M11), TCN-542 (5079_A16), TCN-543 (5081_G23), TCN-544 (5082_A19), TCN-545 (5082_I15), TCN-546 (5089_L08), TCN-547 (5092_F11), TCN-548 (5092_P01), TCN-549 (5092_P04), TCN-550 (5096_F06), TCN-551 (5243_D01), TCN-552 (5249_I23), TCN-553 (5261_C18), TCN-554 (5277_M05), TCN-555 (5246_L16), TCN-556 (5089_K12), TCN-557 (5081_A04), TCN 558 (5248_H10b), TCN-559 (5097_G08), TCN-560 (5084_P10), TCN-504 (3251_K17), SC06-141, SC06-255, SC06-257, SC06-260, SC06-261, SC06-262, SC06-268, SC06-272, SC06-296, SC06-301, SC06-307, SC06-310, SC06-314, SC06-323, SC06-325, SC06-327, SC06-328, SC06-329, SC06-331, SC06-332, SC06-334, SC06-336, SC06-339, SC06-342, SC06-343, SC06-344, CR6141, CR6255, CR6257, CR6260, CR6261, CR6262, CR6268, CR6272, CR6296, CR6301, CR6307, CR6310, CR6314, CR6323, CR6325, CR6327, CR6328, CR6329, CR6331, CR6332, CR6334, CR6336, CR6339, CR6342, CR6343, CR6344, D7, D8, F10, G17, H40, A66, D80, E88, E90, and H98. For example, the multivalent vaccine may include one or more of the following epitopes: GVTNKVNSIIDK (SEQ ID NO: 198), GVTNKVNSIINK (SEQ ID NO: 283), GVTNKENSI-IDK (SEQ ID NO: 202), GVTNKVNRIIDK (SEQ ID NO: 201), GITNKVNSVIEK (SEQ ID NO: 281), GITNKENS-VIEK (SEQ ID NO: 257), GITNKVNSIIDK (SEQ ID NO: 225), KITSKVNNIVDK (SEQ ID NO: 216), MSLLTE-VETPTRNEWGCRCNDSSD (SEQ ID NO: 1), and MSLLTEVETPTRNEWGCRCNDSSD (SEQ ID NO: 1) provided in its native conformation.

The multivalent vaccine also includes a composition including: (a) a human antibody that specifically binds to an epitope of the hemagglutinin (HA) glycoprotein of an influenza virus; and (b) a human monoclonal antibody that specifically binds to an epitope in the extracellular domain of the matrix 2 ectodomain (M2e) polypeptide of an influenza virus.

The invention provides a pharmaceutical composition including any one of the compositions described herein. Moreover, the pharmaceutical composition includes a pharmaceutical carrier.

The invention provides a method for stimulating an immune response in a subject, including administering to the subject the pharmaceutical composition described herein. The pharmaceutical composition may administered prior to or after exposure of the subject to an Influenza virus.

The invention also provides a method for the treatment of an influenza virus infection in a subject in need thereof, including administering to the subject the pharmaceutical composition described herein. The subjection may have been exposed to an influenza virus. Alternatively, or in addition, the subject has not been diagnosed with an influenza infection. The pharmaceutical composition may administered prior to or after exposure of the subject to an Influenza virus. Preferably, the pharmaceutical composition is administered at a dose sufficient to promote viral clearance or eliminate influenza infected cells.

The invention further provides a method for the prevention of an influenza virus infection in a subject in need thereof, including administering to the subject a vaccine composition described herein, prior to exposure of the subject to an influenza virus. In certain embodiments of this method, the subject is at risk of contracting an influenza infection. The pharmaceutical composition may administered prior to or after exposure of the subject to an Influenza virus. Preferably, the pharmaceutical composition is administered at a dose sufficient to promote viral clearance or eliminate influenza infected cells.

The treatment and prevention methods provided by the invention further include administering an anti-viral drug, a viral entry inhibitor or a viral attachment inhibitor. Exemplary anti-viral drugs include, but are not limited to, a neuraminidase inhibitor, a HA inhibitor, a sialic acid inhibitor, or an M2 ion channel inhibitor. In certain aspects of these methods, the M2 ion channel inhibitor is amantadine or rimantadine. In other aspects of these methods, the neuraminidase inhibitor is zanamivir or oseltamivir phosphate. The antiviral drug may administered prior to or after exposure of the subject to an Influenza virus.

The treatment and prevention methods provided by the invention further include administering a second anti-Influenza A antibody. The second antibody is optionally an antibody described herein. The second antibody may administered prior to or after exposure of the subject to an Influenza virus.

The invention provides a method for determining the presence of an Influenza virus infection in a subject, including the steps of: (a) contacting a biological sample obtained from the subject with any one of the antibodies or pharmaceutical compositions described herein; (b) detecting an amount of the antibody that binds to the biological sample; and (c) comparing the amount of antibody that binds to the biological sample to a control value, and therefrom determining the presence of the Influenza virus in the subject. Optionally, the control value is determined by contacting a control sample obtained from the subject with any one of the antibodies or pharmaceutical compositions described herein and detecting an amount of the antibody that binds to the control sample.

The invention also provides a diagnostic kit including any one of the antibodies, compositions, or pharmaceutical compositions described herein.

The invention further provides a prophylactic kit including a vaccine composition described herein. Preferably, the vaccine is a multivalent vaccine. The term "multivalent vaccine" describes a single vaccine that elicits an immune response either to more than one infectious agent, e.g. the influenza HA glycoprotein and the influenza M2e polypeptide, or to several different epitopes of a molecule, e.g. HA epitopes shown in SEQ ID NOs 198, 283, 202, 201, 281, 257, 225, and 216. Alternatively, or in addition, the term multivalent vaccine is meant to describe the administration of a combination of human antibodies raised against more than one infectious agent, e.g. the influenza HA glycoprotein and the influenza M2e polypeptide.

Other features and advantages of the invention will be apparent from and are encompassed by the following detailed description and claims.

BRIEF DESCRIPTION OF THE DRAWINGS

FIG. 6A is a chart showing cross reactivity binding of anti-M2 antibodies to variant M2 peptides (SEQ ID NOS 680-704, respectively, in order of appearance).

FIG. 6B is a chart showing binding activity of M2 antibodies to truncated M2 peptides (SEQ ID NOS 680, 705-724 & 19, respectively, in order of appearance).

FIG. 7 is a graph showing survival of influenza infected mice treated with human anti-influenza monoclonal antibodies.

Figure 12A:
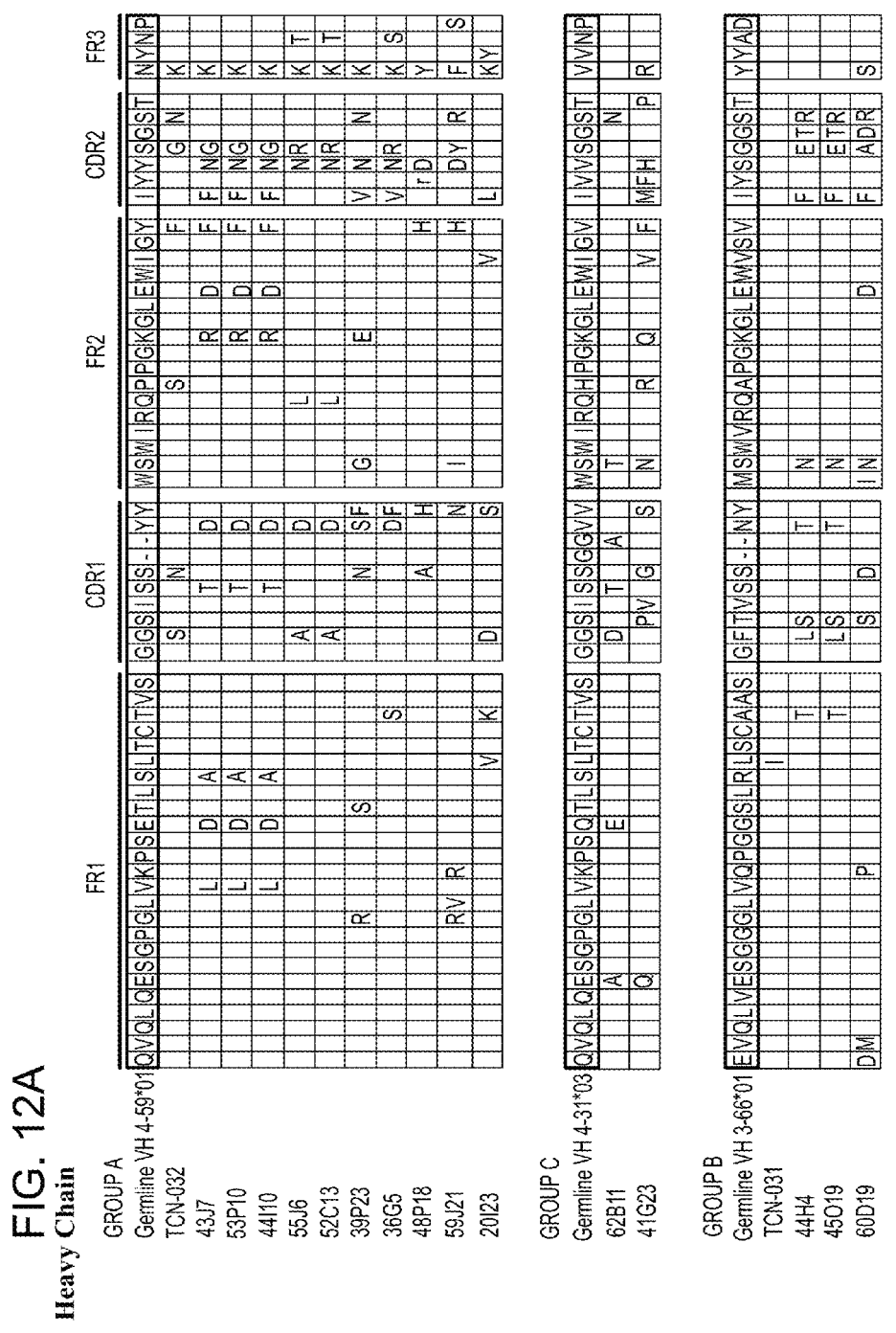
Figure 12A:
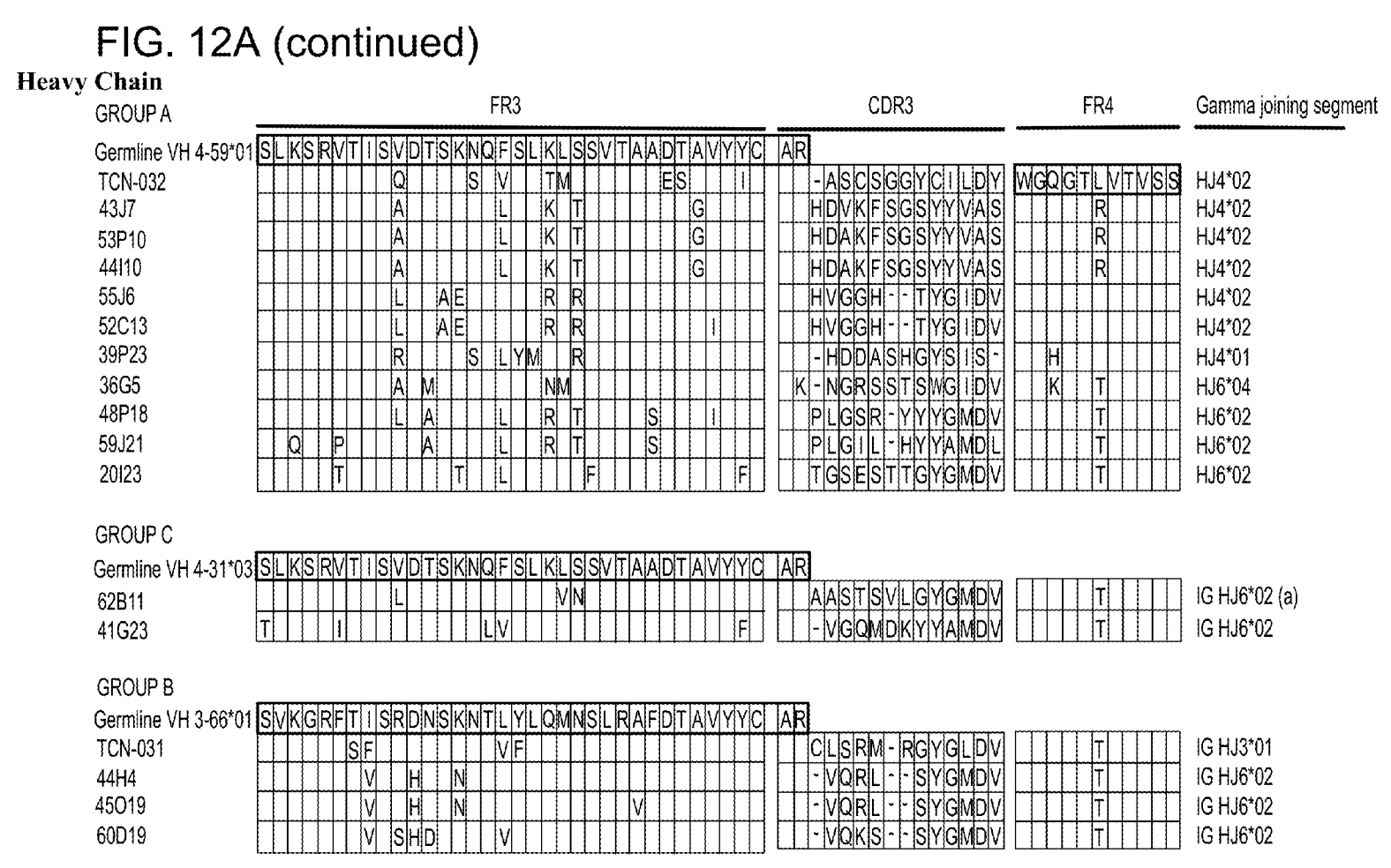
Figure 12B:
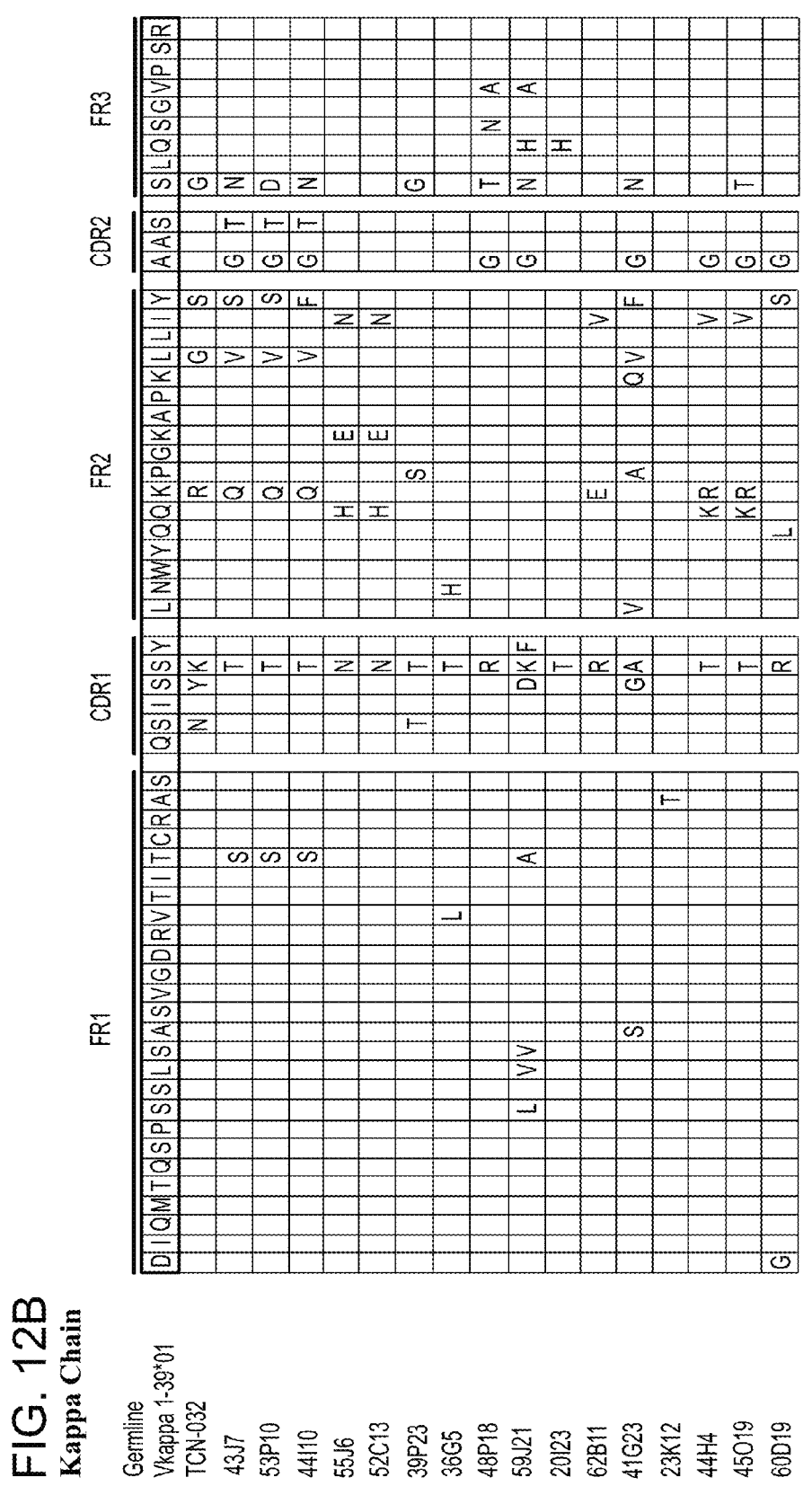

FIGS. 12A-B are amino acid sequences of the variable regions of anti-M2e mAbs. Framework regions 1-4 (FR 1-4) and complementarity determining regions 1-3 (CDR 1-3) for VH and Vk are shown. FR, CDR, and gene names are defined using the nomenclature in the IMGT database (IMGT®, the International ImMunoGeneTics Information system® http:// www.imgt.org). Grey boxes denote identity with the germline sequence which is shown in light blue boxes, hyphens denote gaps, and white boxes are amino acid replacement mutations from the germline.

Figure 13:
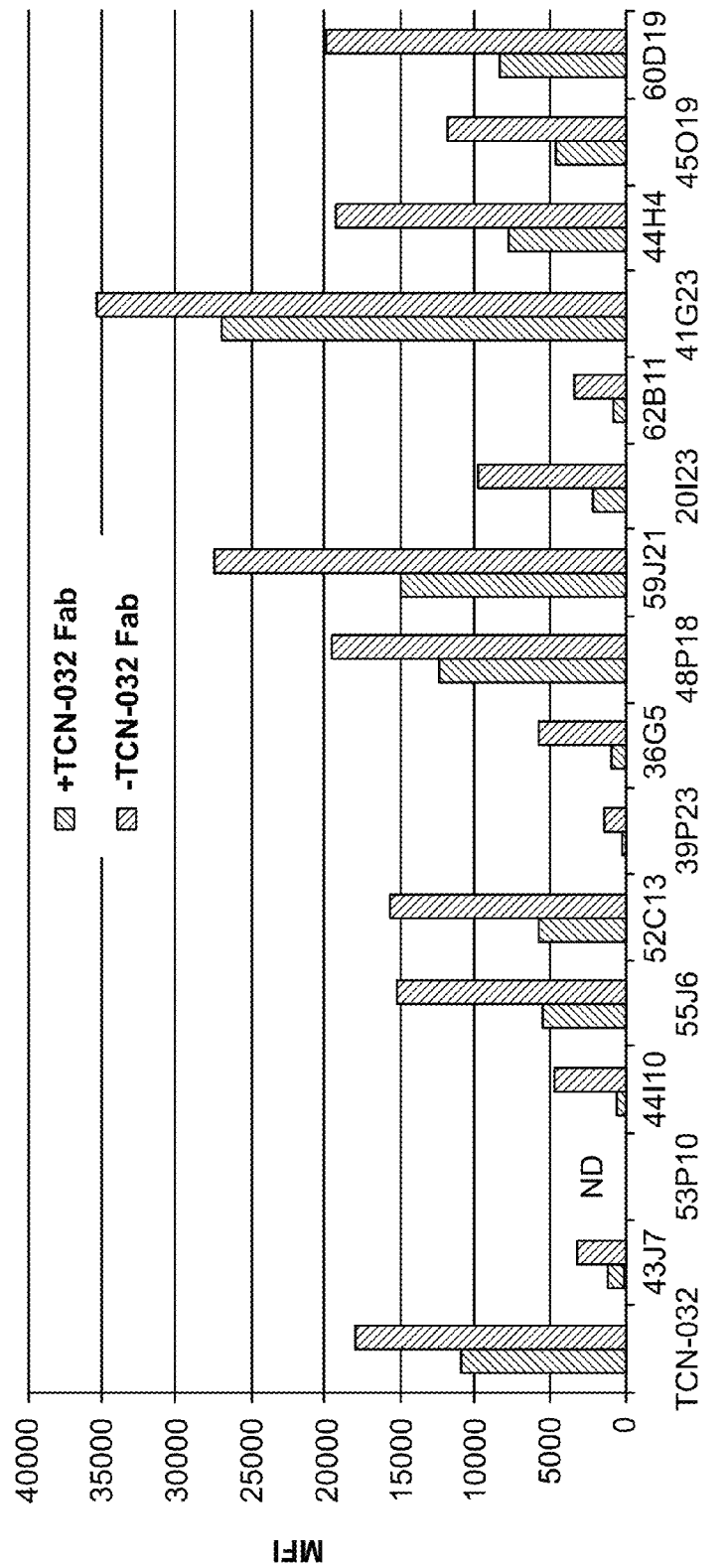

FIG. 13 is a graph depicting the results of a competition binding analysis of a panel of anti-M2e mAbs with TCN-032 Fab. The indicated anti-M2e mAbs were used to bind to the stable CHO transfectant expressing M2 of A/Hong Kong/483/97 that had previously been treated with or without 10 μg/mL TCN-032 Fab fragment. The anti-M2e mAb bound to the cell surface was detected with goat anti-huIgG FcAlexafluor488 FACS and analyzed by flow cytometry. The results are derived from one experiment.

Figure 14A:
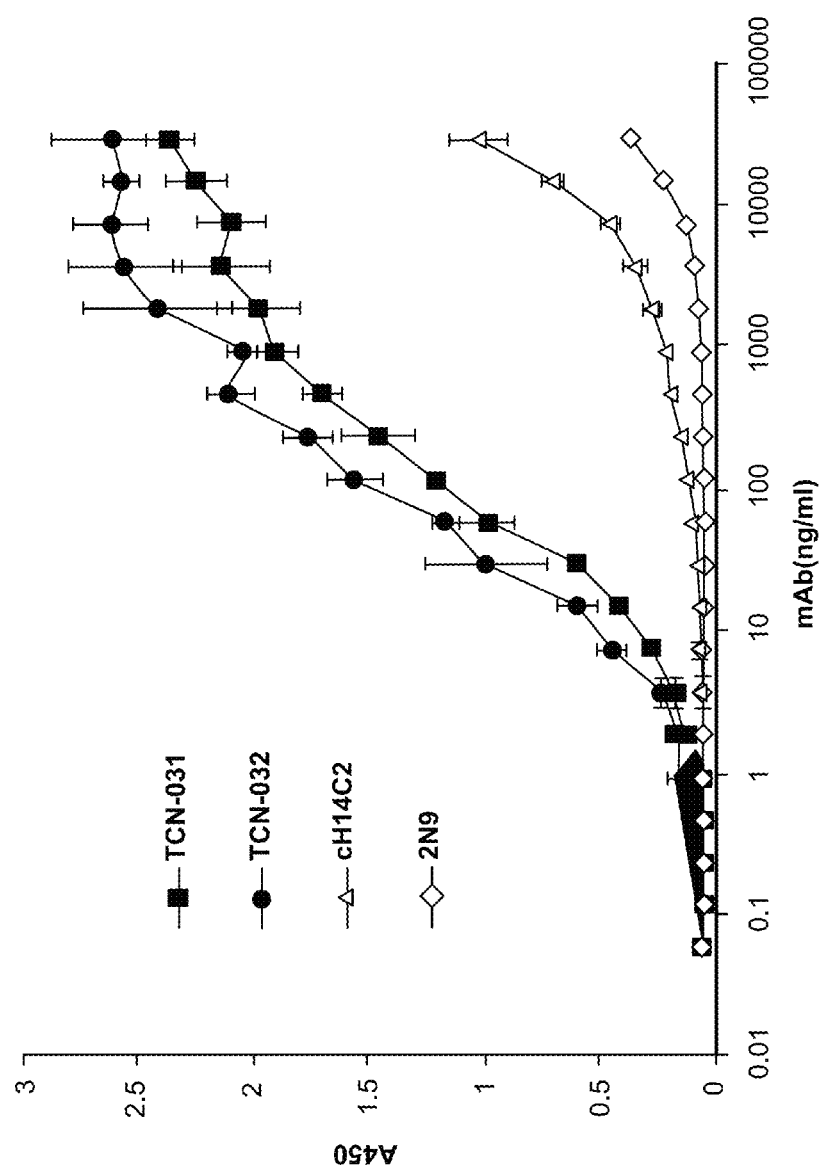

FIG. 14A is a graph depicting the ability of anti-M2e mAbs TCN-032 and TCN-031 to bind virus particles and virus-infected cells but not M2e-derived synthetic peptide. Purified influenza virus (A/Puerto Rico/8/34) was coated at 10 μg/ml on ELISA wells and binding of anti-M2e mAbs TCN-031, TCN-032, ch14C2, and the HCMV mAbs 2N9 was evaluated using HRP-labeled goat anti-human Fc. Results shown are representative of 3 experiments.

Figure 14B:
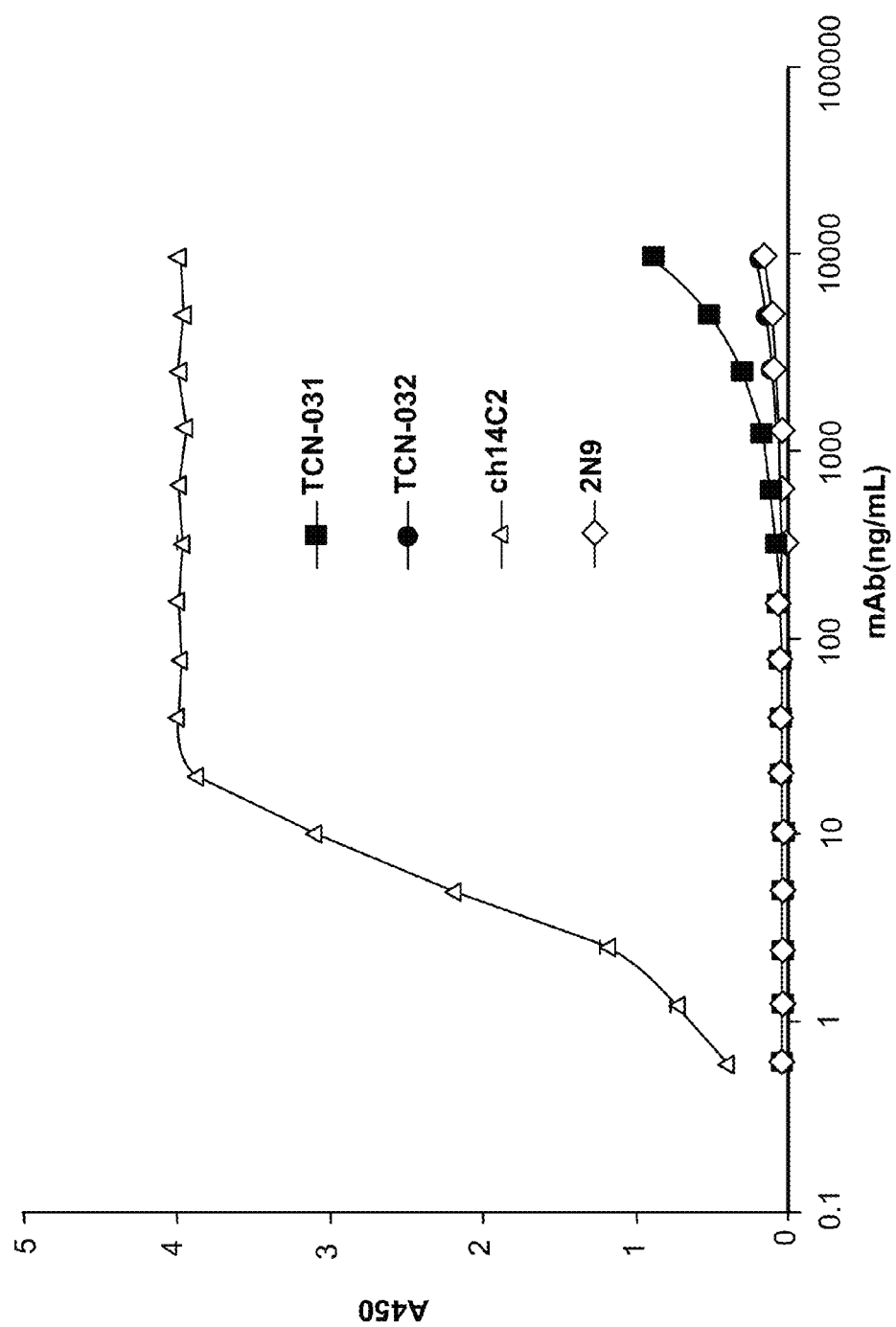

FIG. 14B is a graph depicting the ability of anti-M2e mAbs TCN-032 and TCN-031 to bind virus particles and virus-infected cells but not M2e-derived synthetic peptide. 23 mer synthetic peptide of M2 derived from A/Fort Worth/1/50 was coated at 1 μg/ml on ELISA wells and binding of mAbs TCN-031, TCN-032, ch14C2, and 2N9 were evaluated as in panel a. Results shown are representative of 3 experiments.

FIG. 14C is a graph depicting the ability of anti-M2e mAbs TCN-032 and TCN-031 to bind virus particles and virus-infected cells but not M2e-derived synthetic peptide. MDCK cells were infected with A/Puerto Rico/8/34 (PR8) and subsequently stained with mAbs TCN-031, TCN-032, ch14C2 and the HCMV mAb 5J12. Binding of antibodies was detected using Alexafluor 647-conjugated goat anti-Human IgG H&L antibody and quantified by flow cytometry. Results shown are representative of 3 experiments.

Figure 14D:
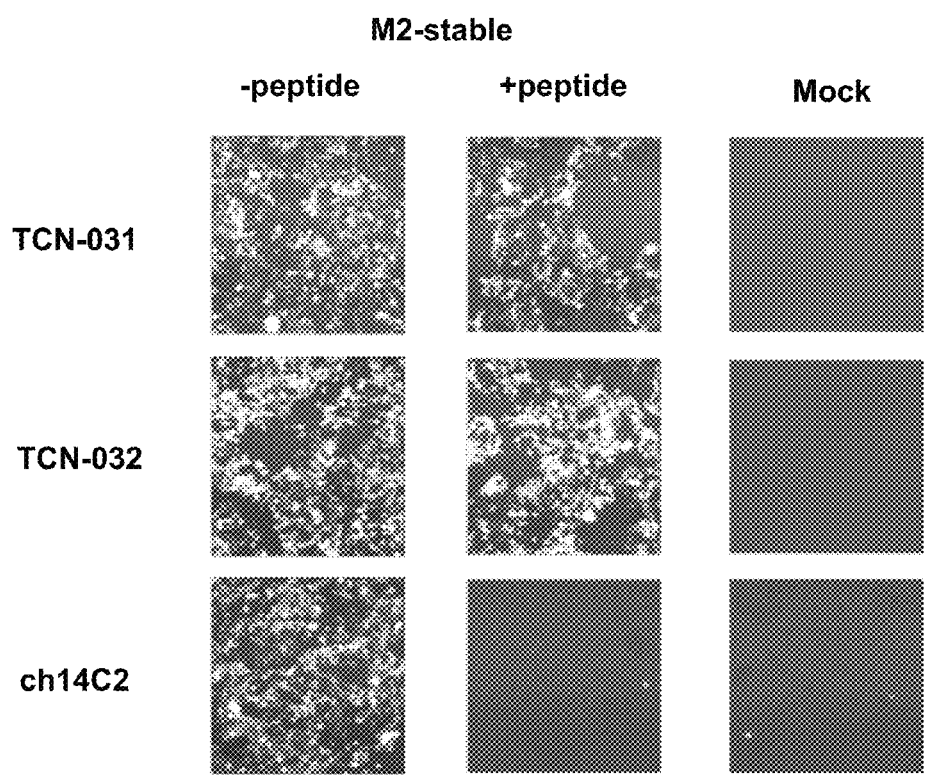

FIG. 14D is a series of photographs depicting HEK 293 cells stably transfected with the M2 ectodomain of A/Fort Worth/1/50 (D20) were stained with transient transfection supernatant containing mAbs TCN-031, TCN-032, or the control ch14C2 and analyzed by FMAT for binding to M2 in the presence or absence of 5 ug/ml M2e peptide. Mock transfected cells are 293 cells stably transfected with vector alone. Results shown are representative of one experiment.

FIGS. 15A-D are graphs depicting the Therapeutic efficacy of anti-M2 mAbs TCN-031 and TCN-032 in mice. Mice (n=10) were infected by intranasal inoculation with $5 \times_{LD50}$ A/Vietnam/1203/04 (H5N1) (panels A-B) or (n=5) with $5 \times_{LD50}$ A/Puerto Rico 8/34 (H1N1) (panels C-D), followed by 3 intraperitoneal (ip) injections with mAbs at 24, 72, and 120 hours post-infection (a total of 3 mAb injections per mouse) and weighed daily for 14 days. Percentage survival is shown in a and c, whereas percent weight change of mice is shown in B and D. The results shown for the treatment study of mice infected with A/Vietnam/1203/04 (H5N1) are representative of 2 experiments.

Figure 16:
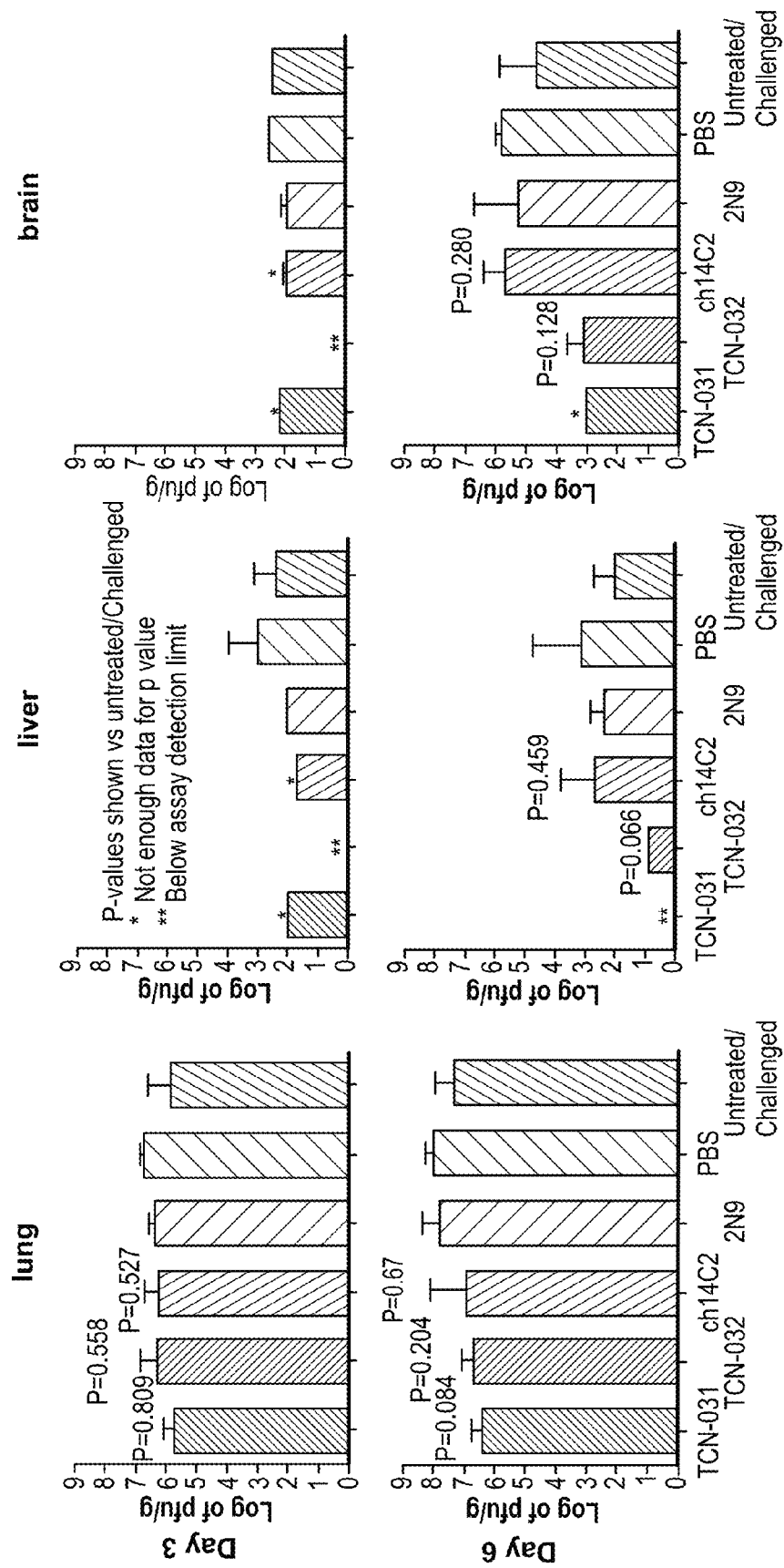

FIG. 16 is a series of graphs depicting the viral titers in lung, liver, and brain of mice treated with anti-M2e mAbs TCN-031 and TCN-032 after challenge with H5N1 A/Vietnam/1203/04. BALB/C mice (n=19) were treated i.p. injection of a 400 μg/200 μL dose of TCN-031, TCN-032, control human mAb 2N9, control chimeric mAb ch14C2, PBS, or left untreated. Tissue viral titers were determined from 3 mice per group at 3 and 6 days post-infection in the lungs (as an indicator of local replication) and in liver and brain (as an indicator of the systemic spread which is characteristic of H5N1 infection).

Figure 17:
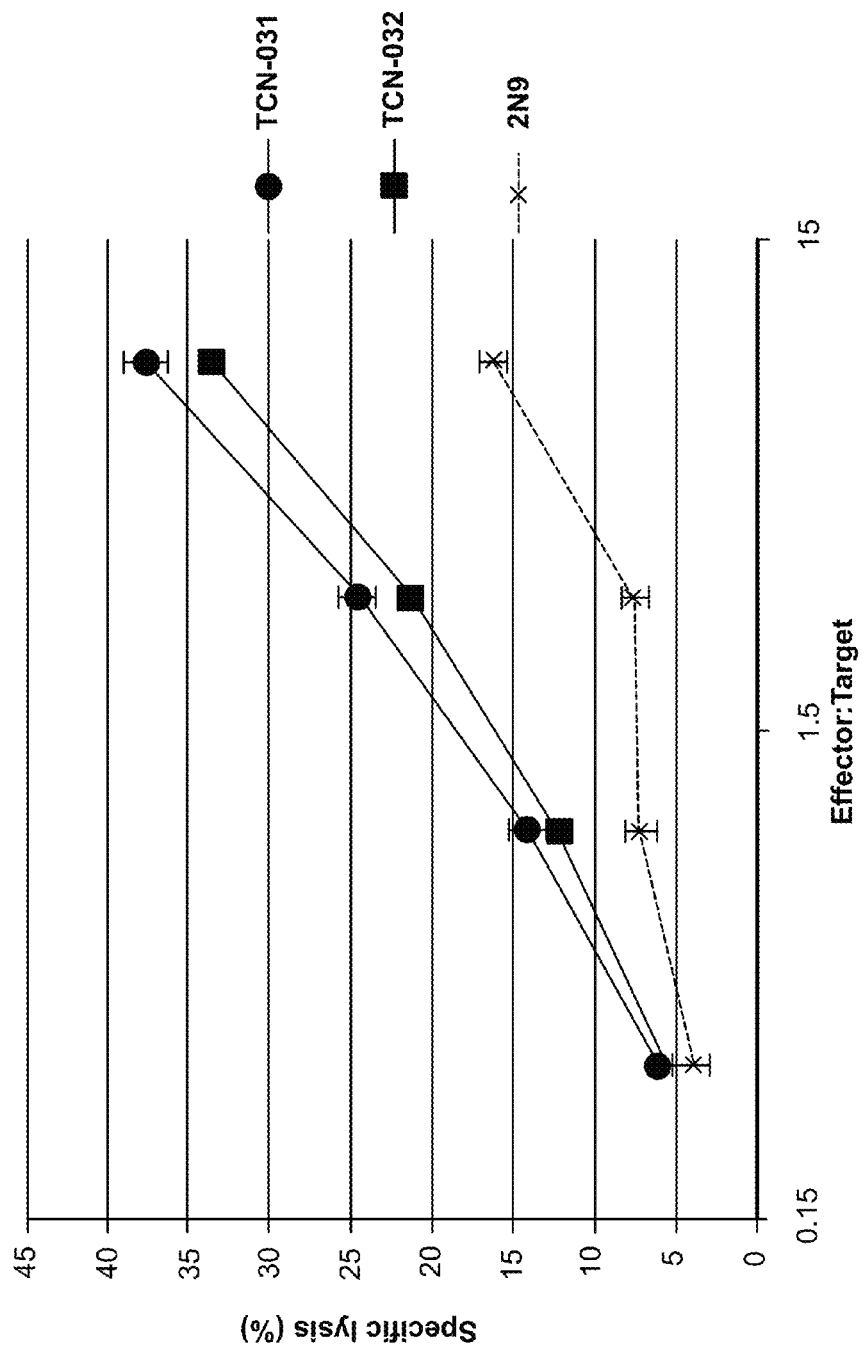

FIG. 17 is a graph depicting the ability of TCN-031 and TCN-032 can potentiate cytolysis by NK cells. MDCK cells were infected with A/Solomon Island/3/2006 (H1N1) virus, and were treated with mAbs TCN-031, TCN-032, or the subclass-matched negative control mAb 2N9. The cells were then challenged with purified human NK cells, and the lactate dehydrogenase released as a result of cell lysis was measured through light absorbance. The results are representative of two separate experiments with two different normal human donors.

Figure 18:
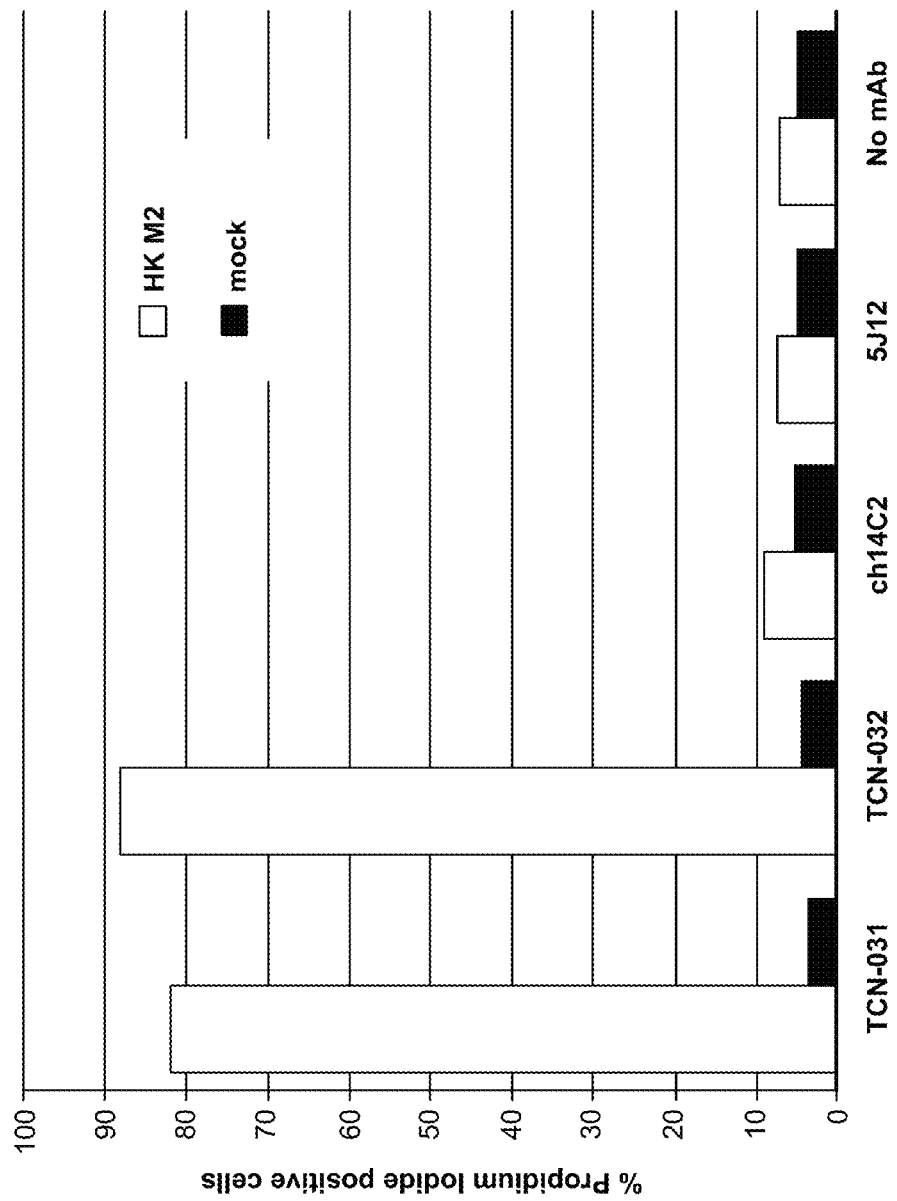

FIG. 18 is a graph depicting complement-dependent cytolysis (CDC) of M2-expressing cells bound with anti-M2 mAb. The stable transfectant expressing M2 of A/Hong Kong/483/97 and a mock control were treated with the indicated mAbs and subsequently challenged with human complement. Lysed cells were visualized by Propidium Iodide staining followed by FACS analysis. The data are representative of two experiments.

Figure 19A:
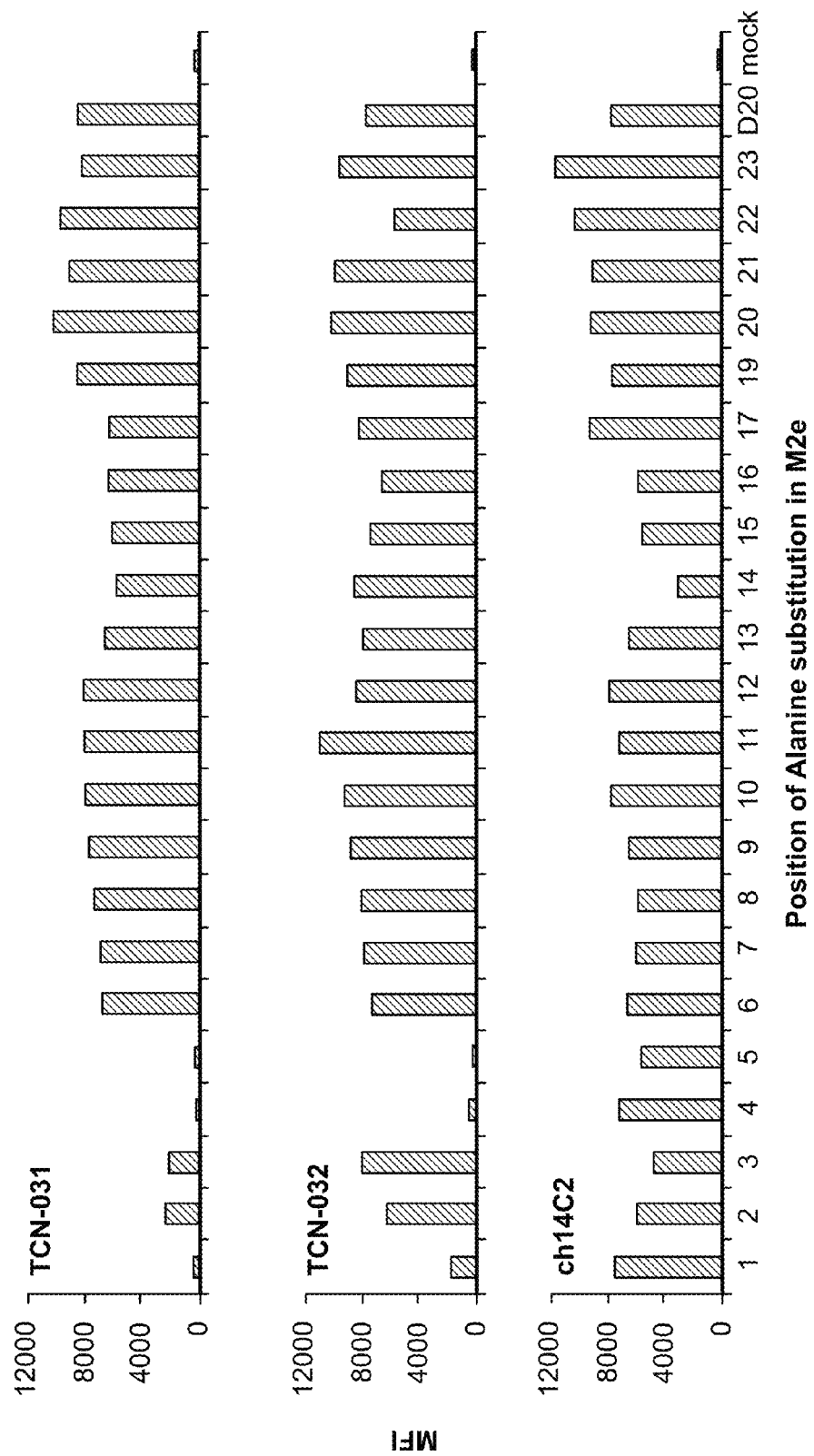
Figure 19C:
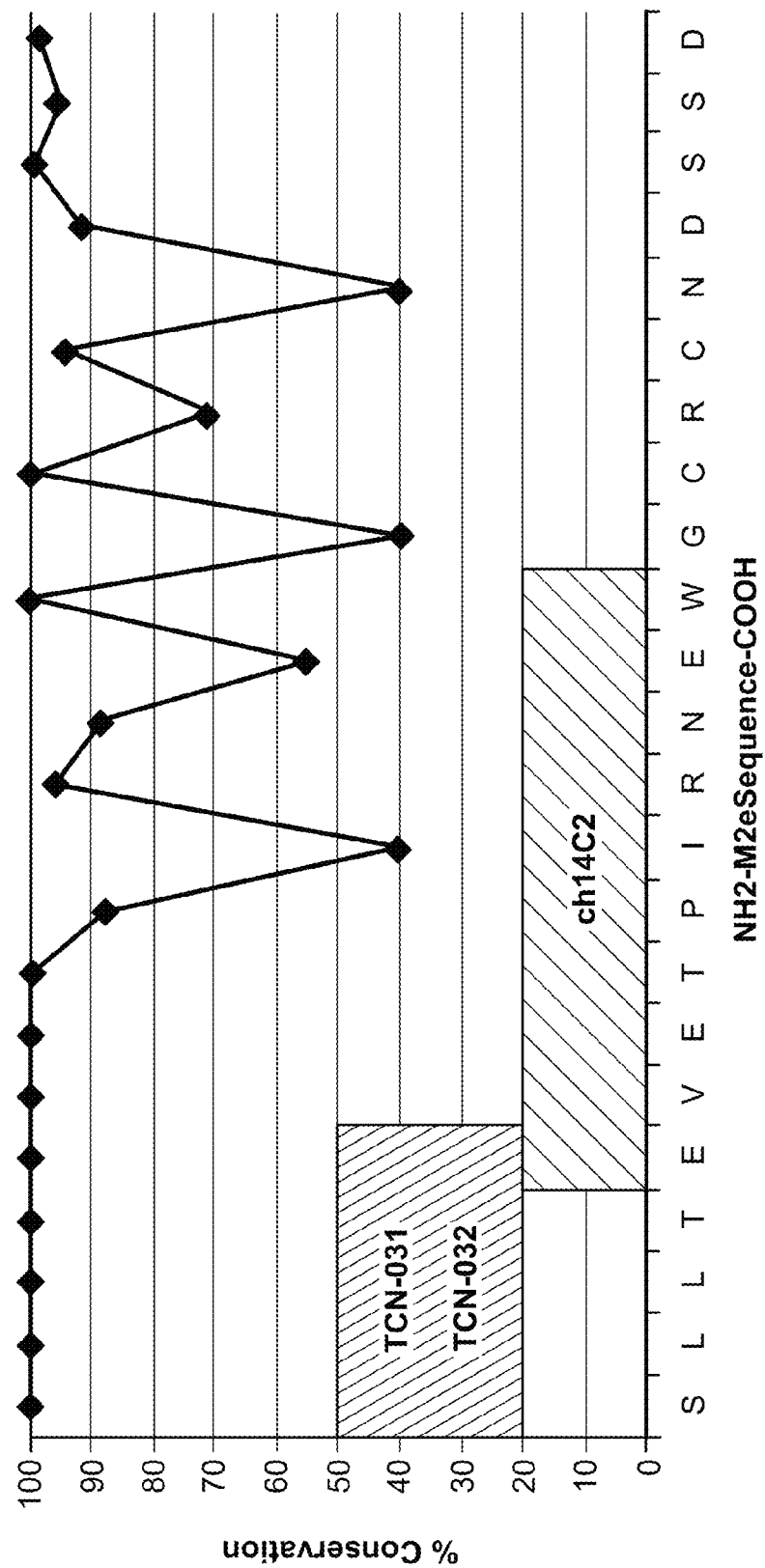

FIGS. 19A-C are graphs depicting binding of anti-M2e mAbs TCN-031 and TCN-032 to M2 mutants indicates the epitope is located in the highly conserved N-terminal of M2e. Mutants with alanine substituted at each position of the M2 ectodomain of A/Fort Worth/1/50 (D20) (A) or forty wild-type M2 mutants including A/Vietnam/1203/04 (VN) and A/Hong Kong/483/97 (HK) (B) were transiently transfected into 293 cells. The identity of each wild-type M2 mutant is listed in Table 6. Transfected cells were stained with mAbs TCN-031, TCN-032, or the control ch14C2 and analyzed by FACS for binding to M2 at 24 hours post-transfection. mAbs TCN-031 and TCN-032 do not bind variants with amino acid substitutions at positions 1, 4, or 5 of M2e. (C) The deduced epitope for TCN-031 and TCN-032 occurs in a highly conserved region of M2e and is distinct from that found for ch14C2. Results shown for (A) and (B) are representative of 3 experiments.

Figure 20:
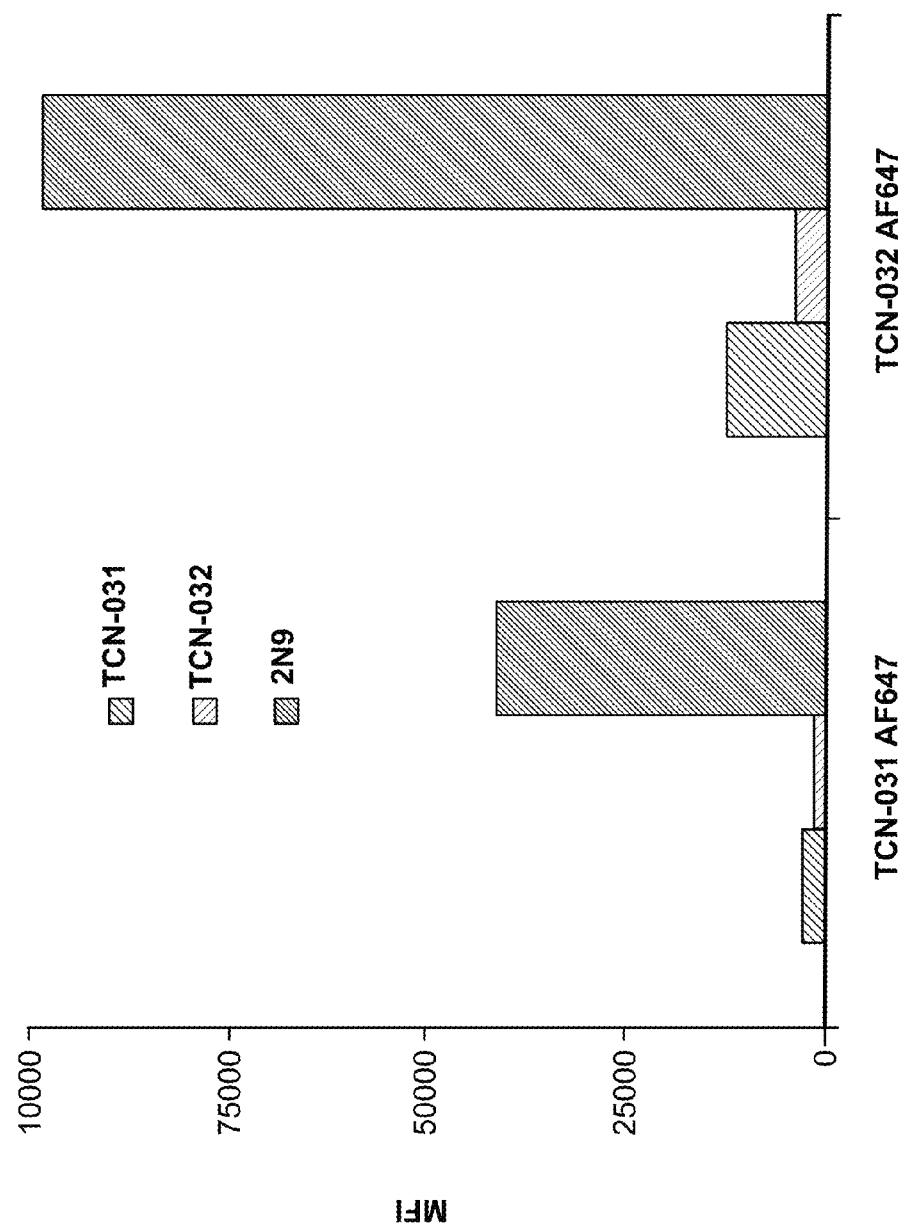

FIG. 20 is a graph depicting mAbs TCN-031 and TCN-032 recognize the same region on M2e. The CHO transfectant stably expressing M2 for A/Hong Kong/483/97 as stained with 10 μg/mL TCN-031, TCN-032, or 2N9, followed by detection with Alexafluor647-labeled TCN-031 (TCN-031AF647) or TCN-032(TCN-032AF647) and analysis by flow cytometry. The results are representative of three experiments.

Figure 21:
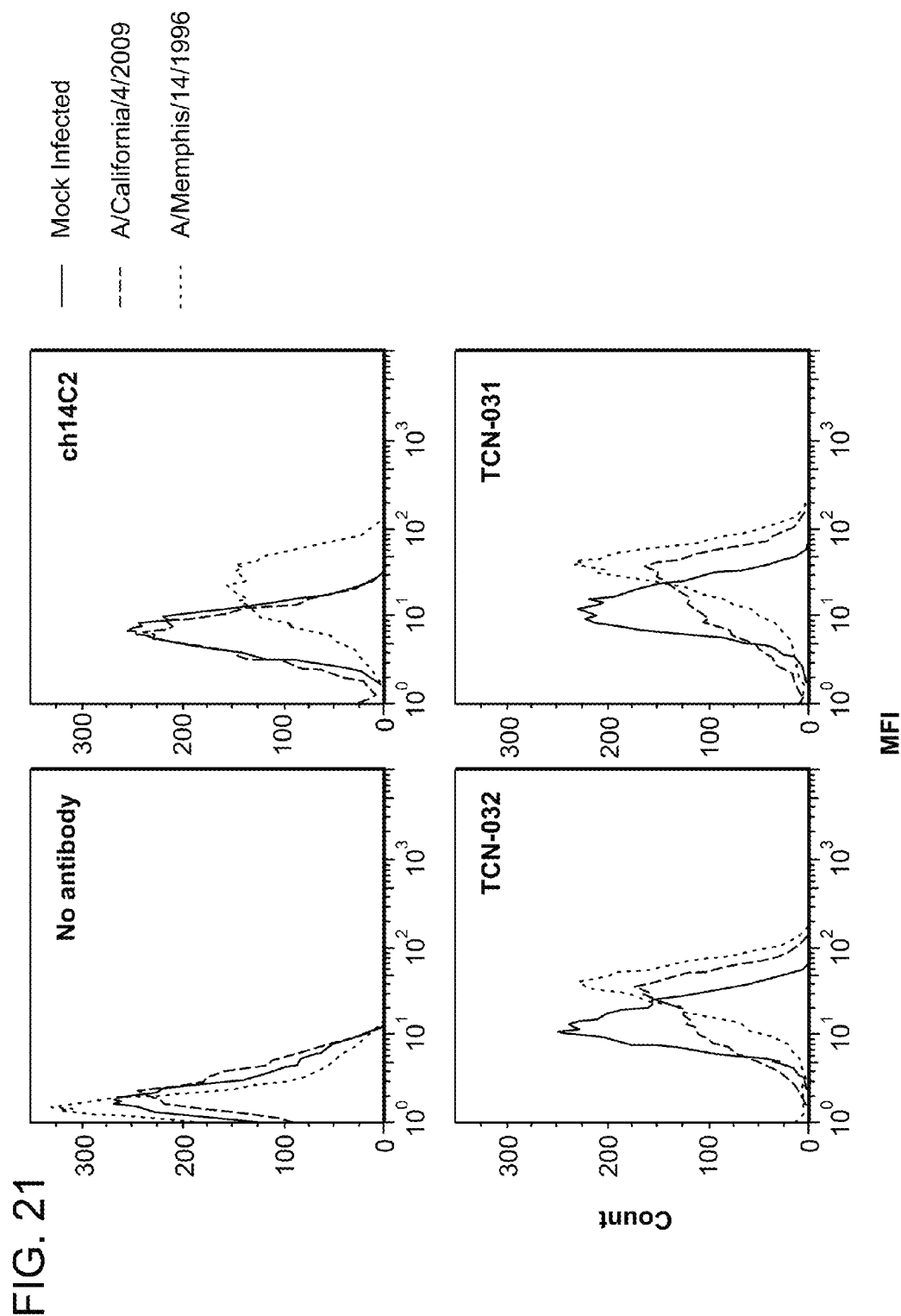

FIG. 21 is a graph depicting anti-M2e mAbs TCN-031 and TCN-032 bind cells that have been infected with H1N1 A/California/4/09. MDCK cells were infected with Influenza A strain H1N1 A/Memphis/14/96, H1N1 A/California/4/09, or mock infected. Twenty four hours post-infection cells were stained with mAbs TCN-031, TCN-032, or the control ch14C2 and analyzed by FACS for binding to M2. Results shown are for one experiment.

DETAILED DESCRIPTION

Influenza viruses consist of three types, A, B and C. Influenza A viruses infect a wide variety of birds and mammals, including humans, horses, marine mammals, pigs, ferrets, and chickens. In animals most influenza A viruses cause mild localized infections of the respiratory and intestinal tract. However, highly pathogenic influenza A strains such as H5N1 exist that cause systemic infections in poultry in which mortality may reach 100%. Animals infected with influenza A often act as a reservoir for the influenza viruses and certain subtypes have been shown to cross the species barrier to humans.

Influenza A viruses can be classified into subtypes based on allelic variations in antigenic regions of two genes that encode surface glycoproteins, namely, hemagglutinin (HA) and neuraminidase (NA) which are required for viral attachment and cellular release. Other major viral proteins include the nucleoprotein, the nucleocapsid structural protein, membrane proteins (M1 and M2), polymerases (PA, PB and PB2) and non-structural proteins (NS1 and NS2). Currently, sixteen subtypes of HA (H1-H16) and nine NA (N1-N9) antigenic variants are known in influenza A virus. Previously, only three subtypes have been known to circulate in humans (H1N1, H1N2, and H3N2).

However, in recent years, the pathogenic H5N1 subtype of avian influenza A has been reported to cross the species barrier and infect humans as documented in Hong Kong in 1997 and 2003, leading to the death of several patients. In humans, the avian influenza virus infects cells of the respiratory tract as well as the intestinal tract, liver, spleen, kidneys and other organs. Symptoms of avian influenza infection include fever, respiratory difficulties including shortness of breath and cough, lymphopenia, diarrhea and difficulties regulating blood sugar levels. In contrast to seasonal influenza, the group most at risk is healthy adults, which make up the bulk of the population. Due to the high pathogenicity of certain avian influenza A subtypes, particularly H5N1, and their demonstrated ability to cross over to infect humans, there is a significant economic and public health risk associated with these viral strains, including a real epidemic and pandemic threat. The scale of the threat is illustrated by the 1918 influenza pandemic which killed over 50 million people.

Currently, no effective vaccines for H5N1 infection are available, so passive immunotherapy with immunoglobulins may be an alternative strategy. Use of passive immunization during the 1918 pandemic reportedly halved the death rate. In view of their therapeutic benefit in humans, there is thus a need for antibodies, preferably human antibodies, capable of neutralizing influenza infection, including H5N1.

The invention provides compositions including human antibodies raised against two influenza proteins, hemagglutinin (HA) and matrix 2 ectodomain (M2e), and shows that these compositions can be used in medicine, in particular for diagnosis, prevention and treatment of influenza infections, including H5N1.

HuM2e Antibodies

The present invention provides fully human monoclonal antibodies specifically directed against M2e. Optionally, the antibody is isolated form a B-cell from a human donor. Exemplary monoclonal antibodies include TCN-032 (8I10), 21B15, TCN-031 (23K12), 3241_G23, 3244_I10, 3243_J07, 3259_J21, 3245_O19, 3244_H04, 3136_G05, 3252_C13, 3255_J06, 3420_I23, 3139_P23, 3248_P18, 3253_P10, 3260_D19, 3362_B11, and 3242_P05.described herein. Alternatively, the monoclonal antibody is an antibody that binds to the same epitope as TCN-032 (8I10), 21B15, TCN-031 (23K12), 3241_G23, 3244_I10, 3243_J07, 3259_J21, 3245_O19, 3244_H04, 3136_G05, 3252_C13, 3255_J06, 3420_I23, 3139_P23, 3248_P18, 3253_P10, 3260_D19, 3362_B11, and 3242_P05. The antibodies respectively referred to herein are huM2e antibodies. The huM2e antibody has one or more of the following characteristics: a) binds to an epitope in the extracellular domain of the matrix 2 ectodomain (M2e) polypeptide of an influenza virus; b) binds to influenza A infected cells; or c) binds to influenza A virus.

The epitope that huM2e antibody binds to is a non-linear epitope of a M2 polypeptide. Preferably, the epitope includes the amino terminal region of the M2e polypeptide. More preferably the epitope wholly or partially includes the amino acid sequence SLLTEV (SEQ ID NO: 42). Most preferably, the epitope includes the amino acid at position 2, 5 and 6 of the M2e polypeptide when numbered in accordance with SEQ ID NO: 1. The amino acid at position 2 is a serine; at position 5 is a threonine; and at position 6 is a glutamic acid.

A huM2e antibody contains a heavy chain variable having the amino acid sequence of SEQ ID NOs: 44, 277, 276, 50, 236, 235, 116, 120, 124, 128, 132, 136, 140, 144, 148, 152, 156, 160, 164, 168, 172, or 176 and a light chain variable having the amino acid sequence of SEQ ID NOs: 46, 52, 118, 122, 126, 130, 134, 138, 142, 146, 150, 154, 158, 162, 166, 170, 174, or 178. Preferably, the three heavy chain CDRs include an amino acid sequence at least 90%, 92%, 95%, 97% 98%, 99% or more identical to the amino acid sequence of SEQ ID NOs: 72, 74, 76, 103, 105, 107, 179, 180, 181, 187, 188, 189, 197, 203, 204, 205, 21, 212, 213, 228, 229, 230, 237, 238, 252, 253, 254, 260, 261, 262, 268, 269, 270, 284, 285, 286, 293, 294, 295, and 301 (as determined by the Kabat method) or SEQ ID NOs: 109, 110, 76, 112, 113, 107, 182, 183, 181, 190, 191, 189, 197, 206, 207, 205, 214, 215, 213, 232, 230, 239, 240, 238, 255, 256, 254, 263, 264, 262, 271, 272, 270, 287, 288, 286, 296, 297, 295, and 304 (as determined by the Chothia method) and a light chain with three CDRs that include an amino acid sequence at least 90%, 92%, 95%, 97% 98%, 99% or more identical to the amino acid sequence of SEQ ID NOs: 59, 60, 61, 92, 94, 96, 184, 185, 186, 192, 193, 194, 208, 209, 210, 217, 218, 226, 223, 234, 241, 243, 258, 259, 265, 267, 273, 274, 275, 282, 291, and 300 (as determined by the Kabat method) or SEQ ID NOs: 59, 60, 61, 92, 94, 96, 184, 185, 186, 192, 193, 194, 208, 209, 210, 217, 218, 226, 223, 234, 241, 243, 258, 259, 265, 267, 273, 274, 275, 282, 291, and 300 (as determined by the Chothia method). The antibody binds M2e.

The heavy chain of a M2e antibody is derived from a germ line V (variable) gene such as, for example, the IgHV4 or the IgHV3 germline gene.

The M2e antibodies of the invention include a variable heavy chain ($V_H$) region encoded by a human IgHV4 or the IgHV3 germline gene sequence. A IgHV4 germline gene sequence are shown, e.g., in Accession numbers L10088, M29812, M95114, X56360 and M95117. IgHV3 germline gene sequence are shown, e.g., in Accession numbers X92218, X70208, Z27504, M99679 and AB019437. The M2e antibodies of the invention include a $V_H$ region that is encoded by a nucleic acid sequence that is at least 80% homologous to the IgHV4 or the IgHV3 germline gene sequence. Preferably, the nucleic acid sequence is at least 90%, 95%, 96%, 97% homologous to the IgHV4 or the IgHV3 germline gene sequence, and more preferably, at least 98%, 99% homologous to the IgHV4 or the IgHV3 germline gene sequence. The $V_H$ region of the M2e antibody is at least 80% homologous to the amino acid sequence of the $V_H$ region encoded by the IgHV4 or the IgHV3 $V_H$ germline gene sequence. Preferably, the amino acid sequence of $V_H$ region of the M2e antibody is at least 90%, 95%, 96%, 97% homologous to the amino acid sequence encoded by the IgHV4 or the IgHV3 germline gene sequence, and more preferably, at least 98%, 99% homologous to the sequence encoded by the IgHV4 or the IgHV3 germline gene sequence.

The M2e antibodies of the invention also include a variable light chain ($V_L$) region encoded by a human IgKV1 germline gene sequence. A human IgKV1 $V_L$ germline gene sequence is shown, e.g., Accession numbers X59315, X59312, X59318, J00248, and Y14865. Alternatively, the M2e antibodies include a $V_L$ region that is encoded by a nucleic acid sequence that is at least 80% homologous to the IgKV1 germline gene sequence. Preferably, the nucleic acid sequence is at least 90%, 95%, 96%, 97% homologous to the IgKV1 germline gene sequence, and more preferably, at least 98%, 99% homologous to the IgKV1 germline gene sequence. The $V_L$ region of the M2e antibody is at least 80% homologous to the amino acid sequence of the $V_L$ region encoded the IgKV1 germline gene sequence. Preferably, the amino acid sequence of $V_L$ region of the M2e antibody is at least 90%, 95%, 96%, 97% homologous to the amino acid sequence encoded by the IgKV1 germline gene sequence, and more preferably, at least 98%, 99% homologous to the sequence encoded by e the IgKV1 germline gene sequence.

In another aspect the invention provides a composition including an huM2e antibody according to the invention. In various aspects the composition further includes an anti-viral drug, a viral entry inhibitor or a viral attachment inhibitor. The anti-viral drug is for example a neuraminidase inhibitor, a HA inhibitor, a sialic acid inhibitor or an M2 ion channel inhibitor. The M2 ion channel inhibitor is for example amantadine or rimantadine. The neuraminidase inhibitor for example zanamivir, or oseltamivir phosphate. In a further aspect the composition further includes a second anti-influenza A antibody.

In a further aspect the huM2e antibodies according to the invention are operably-linked to a therapeutic agent or a detectable label.

Additionally, the invention provides methods for stimulating an immune response, treating, preventing or alleviating a symptom of an influenza viral infection by administering an huM2e antibody to a subject Optionally, the subject is further administered with a second agent such as, but not limited to, an influenza virus antibody, an anti-viral drug such as a neuraminidase inhibitor, a HA inhibitor, a sialic acid inhibitor or an M2 ion channel inhibitor, a viral entry inhibitor or a viral attachment inhibitor. The M2 ion channel inhibitor is, for example, amantadine or rimantadine. The neuraminidase inhibitor is, for example, zanamivir or oseltamivir phosphate. The subject is suffering from or is predisposed to developing an influenza virus infection, such as, for example, an autoimmune disease or an inflammatory disorder.

In another aspect, the invention provides methods of administering the huM2e antibody of the invention to a subject prior to, and/or after exposure to an influenza virus. For example, the huM2e antibody of the invention is used to treat or prevent rejection influenza infection. The huM2e antibody is administered at a dose sufficient to promote viral clearance or eliminate influenza A infected cells.

Also included in the invention is a method for determining the presence of an influenza virus infection in a patient, by contacting a biological sample obtained from the patient with a humM2e antibody; detecting an amount of the antibody that binds to the biological sample; and comparing the amount of antibody that binds to the biological sample to a control value.

The invention further provides a diagnostic kit comprising a huM2e antibody.

Other features and advantages of the invention will be apparent from and are encompassed by the following detailed description and claims.

The present invention provides fully human monoclonal antibodies specific against the extracellular domain of the matrix 2 (M2) polypeptide. The antibodies are respectively referred to herein as huM2e antibodies.

M2 is a 96 amino acid transmembrane protein present as a homotetramer on the surface of influenza virus and virally infected cells. M2 contains a 23 amino acid ectodomain (M2e) that is highly conserved across influenza A strains. Few amino acid changes have occurred since the 1918 pandemic strain thus M2e is an attractive target for influenza therapies. In prior studies, monoclonal antibodies specific to the M2 ectodomain (M2e) were derived upon immunizations with a peptide corresponding to the linear sequence of M2e. In contrast, the present invention provides a novel process whereby full-length M2 is expressed in cell lines, which allows for the identification of human antibodies that bound this cell-expressed M2e. The huM2e antibodies have been shown to bind conformational determinants on the M2-transfected cells, as well as native M2, either on influenza infected cells, or on the virus itself. The huM2e antibodies did not bind the linear M2e peptide, but they do bind several natural M2 variants, also expressed upon cDNA transfection into cell lines. Thus, this invention has allowed for the identification and production of human monoclonal antibodies that exhibit novel specificity for a very broad range of influenza A virus strains. These antibodies may be used diagnostically to identify influenza A infection and therapeutically to treat influenza A infection.

The huM2e antibodies of the invention have one or more of the following characteristics: the huM2e antibody binds a) to an epitope in the extracellular domain of the matrix 2 (M2) polypeptide of an influenza virus; b) binds to influenza A infected cells; and/or c) binds to influenza A virus (i.e., virons). The huM2e antibodies of the invention eliminate influenza infected cells through immune effector mechanisms, such as ADCC, and promote direct viral clearance by binding to influenza virons. The huM2e antibodies of the invention bind to the amino-terminal region of the M2e polypeptide. Preferably, the huM2e antibodies of the invention bind to the amino-terminal region of the M2e polypeptide wherein the N-terminal methionine residue is absent. Exemplary M2e sequences include those sequences listed on Table 1 below

TABLE 1

| Type | Name | Subtype | M2E Sequence | SEQ ID NO |
|---|---|---|---|---|
| A | BREVIG MISSION.1.1918 | H1N1 | MSLLTEVETPTRNEWGCRCNDSSD | SEQ ID NO: 1 |
| A | FORT MONMOUTH.1.1947 | H1N1 | MSLLTEVETPTKNEWECRCNDSSD | SEQ ID NO: 2 |
| A | .SINGAPORE.02.2005 | H3N2 | MSLLTEVETPIRNEWECRCNDSSD | SEQ ID NO: 3 |
| A | WISCONSIN.10.98 | H1N1 | MSLLTEVETPIRNGWECKCNDSSD | SEQ ID NO: 4 |
| A | WISCONSIN.301.1976 | H1N1 | MSLLTEVETPIRSEWGCRCNDSSD | SEQ ID NO: 5 |
| A | PANAMA.1.66 | H2N2 | MSFLPEVETPIRNEWGCRCNDSSD | SEQ ID NO: 6 |

TABLE 1-continued

| Type | Name | Subtype | M2E Sequence | SEQ ID NO |
|---|---|---|---|---|
| A | NEW YORK.321.1999 | H3N2 | MSLLTEVETPIRNEWGCRCNDSSN | SEQ ID NO: 7 |
| A | CARACAS.1.71 | H3N2 | MSLLTEVETPIRKEWGCRCNDSSD | SEQ ID NO: 8 |
| A | TAIWAN.3.71 | H3N2 | MSFLTEVETPIRNEWGCRCNDSSD | SEQ ID NO: 9 |
| A | WUHAN.359.95 | H3N2 | MSLPTEVETPIRSEWGCRCNDSSD | SEQ ID NO: 10 |
| A | HONG KONG.1144.99 | H3N2 | MSLLPEVETPIRNEWGCRCNDSSD | SEQ ID NO: 11 |
| A | HONG KONG.1180.99 | H3N2 | MSLLPEVETPIRNGWGCRCNDSSD | SEQ ID NO: 12 |
| A | HONG KONG.1774.99 | H3N2 | MSLLTEVETPTRNGWECRCSGSSD | SEQ ID NO: 13 |
| A | NEW YORK.217.02 | H1N2 | MSLLTEVETPIRNEWEYRCNDSSD | SEQ ID NO: 14 |
| A | NEW YORK.300.2003 | H1N2 | MSLLTEVETPIRNEWEYRCSDSSD | SEQ ID NO: 15 |
| A | SWINE.SPAIN.54008.2004 | H3N2 | MSLLTEVETPTRNGWECRYSDSSD | SEQ ID NO: 16 |
| A | GUANGZHOU.333.99 | H9N2 | MSFLTEVETLTRNGWECRCSDSSD | SEQ ID NO: 17 |
| A | HONG KONG.1073.99 | H9N2 | MSLLTEVETLTRNGWECKCRDSSD | SEQ ID NO: 18 |
| A | HONG KONG.1.68 | H3N2 | MSLLTEVETPIRNEWGCRCNDSSD | SEQ ID NO: 19 |
| A | SWINE.HONG KONG.126.1982 | H3N2 | MSLLTEVETPIRSEWGCRCNDSGD | SEQ ID NO: 20 |
| A | NEW YORK.703.1995 | H3N2 | MSLLTEVETPIRNEWECRCNGSSD | SEQ ID NO: 21 |
| A | SWINE.QUEBEC.192.81 | H1N1 | MSLPTEVETPIRNEWGCRCNDSSD | SEQ ID NO: 22 |
| A | PUERTO RICO.8.34 | H1N1 | MSLLTEVETPIRNEWGCRCNGSSD | SEQ ID NO: 23 |
| A | HONG KONG.485.97 | H5N1 | MSLLTEVDTLTRNGWGCRCSDSSD | SEQ ID NO: 24 |
| A | HONG KONG.542.97 | H5N1 | MSLLTEVETLTKNGWGCRCSDSSD | SEQ ID NO: 25 |
| A | SILKY CHICKEN.SHANTOU.1826.2004 | H9N2 | MSLLTEVETPTRNGWECKCSDSSD | SEQ ID NO: 26 |
| A | CHICKEN.TAIWAN.0305.04 | H6N1 | MSLLTEVETHTRNGWECKCSDSSD | SEQ ID NO: 27 |
| A | QUAIL.ARKANSAS.16309-7.94 | H7N3NSA | MSLLTEVKTPTRNGWECKCSDSSD | SEQ ID NO: 28 |
| A | HONG KONG.486.97 | H5N1 | MSLLTEVETLTRNGWGCRCSDSSD | SEQ ID NO: 29 |
| A | CHICKEN.PENNSYLVANIA.13552-1.98 | H7N2NSB | MSLLTEVETPTRDGWECKCSDSSD | SEQ ID NO: 30 |
| A | CHICKEN.HEILONGJIANG.48.01 | H9N2 | MSLLTEVETPTRNGWGCRCSDSSD | SEQ ID NO: 31 |
| A | SWINE.KOREA.S5.2005 | H1N2 | MSLLTEVETPTRNGWECKCNDSSD | SEQ ID NO: 32 |
| A | HONG KONG.1073.99 | H9N2 | MSLLTEVETLTRNGWECKCSDSSD | SEQ ID NO: 33 |
| A | WISCONSIN.3523.88 | H1N1 | MSLLTEVETPIRNEWGCKCNDSSD | SEQ ID NO: 34 |
| A | X-31 VACCINE STRAIN | H3N2 | MSFLTEVETPIRNEWGCRCNGSSD | SEQ ID NO: 35 |
| A | CHICKEN.ROSTOCK.8.1934 | H7N1 | MSLLTEVETPTRNGWECRCNDSSD | SEQ ID NO: 36 |
| A | ENVIRONMENT.NEW YORK.16326-1.2005 | H7N2 | MSLLTEVETPIRKGWECNCSDSSD | SEQ ID NO: 37 |
| A | INDONESIA.560H.2006 | H5N1 | MSLLTEVETPTRNEWECRCSDSSD | SEQ ID NO: 38 |
| A | CHICKEN.HONG KONG.SF1.03 | H9N2 | MSLLTGVETHTRNGWGCKCSDSSD | SEQ ID NO: 39 |
| A | CHICKEN.HONGKONG.YU427.03 | H9N2 | MSLLPEVETHTRNGWGCRCSDSSD | SEQ ID NO: 40 |

In one embodiment, the huM2e antibodies of the invention bind to a M2e that wholly or partially includes the amino acid residues from position 2 to position 7 of M2e when numbered in accordance with SEQ ID NO: 1. For example, the huM2e antibodies of the invention bind wholly or partially to the amino acid sequence SLLTEVET (SEQ ID NO: 41) Most preferably, the huM2e antibodies of the invention bind wholly or partially to the amino acid sequence SLLTEV (SEQ ID NO: 42). Preferably, the huM2e antibodies of the invention bind to non-linear epitope of the M2e protein. For example, the huM2e antibodies bind to an epitope comprising position 2, 5, and 6 of the M2e polypeptide when numbered in accordance to SEQ ID NO: 1 where the amino acid at a) position 2 is a serine; b) position 5 is a threonine; and c) position 6 is a glutamic acid. Exemplary huM2e monoclonal antibodies that bind to this epitope are the TCN-032 (8I10), 21B15, TCN-031 (23K12), 3241_G23, 3244_I10, 3243_J07, 3259_J21, 3245_O19, 3244_H04, 3136_G05, 3252_C13, 3255_J06, 3420_I23, 3139_P23, 3248_P18, 3253_P10, 3260_D19, 3362_B11, and 3242_P05 antibodies described herein.

The TCN-032 (8I10) antibody includes a heavy chain variable region (SEQ ID NO: 44) encoded by the nucleic acid sequence shown below in SEQ ID NO: 43, a short heavy chain variable region (SEQ ID NO: 277) encoded by the nucleic acid sequence shown below in SEQ ID NO: 278, a long heavy chain variable region (SEQ ID NO: 276) encoded by the nucleic acid sequence shown below in SEQ ID NO: 196, and a light chain variable region (SEQ ID NO: 46) encoded by the nucleic acid sequence shown in SEQ ID NO: 45.

The amino acids encompassing the CDRs as defined by Chothia, C. et al. (1989, Nature, 342: 877-883) are underlined and those defined by Kabat E. A. et al.(1991, Sequences of Proteins of Immunological Interest, 5th edit., NIH Publication no. 91-3242 U.S. Department of Heath and Human Services.) are highlighted in bold in the sequences below.

The heavy chain CDRs of the TCN-032 (8I10) antibody have the following sequences per Kabat definition: NYYWS (SEQ ID NO: 72), FIYYGGNTKYNPSLKS (SEQ ID NO: 74) and ASCSGGYCILD (SEQ ID NO: 76). The light chain CDRs of the TCN-032 (8I10) antibody have the following sequences per Kabat definition: RASQNIYKYLN (SEQ ID NO: 59), AASGLQS (SEQ ID NO: 61) and QQSYSPPLT (SEQ ID NO: 63).

The heavy chain CDRs of the TCN-032 (8I10) antibody have the following sequences per Chothia definition: GSSISN (SEQ ID NO: 109), FIYYGGNTK (SEQ ID NO: 110) and ASCSGGYCILD (SEQ ID NO: 76). The light chain CDRs of the TCN-032 (8I10) antibody have the following sequences per Chothia definition: RASQNIYKYLN (SEQ ID NO: 59), AASGLQS (SEQ ID NO: 61) and QQSYSPPLT (SEQ ID NO: 63).

TCN-032 (8I10) VH nucleotide sequence:
(SEQ ID NO: 43)
CAGGTGCAATTGCAGGAGTCGGGCCCAGGACTGGTGAAGCCTTCGGAGAC

CCTGTCCCTCACCTGCACTGTCTCTGGTTCGTCCATCAGTAATTACTACT

GGAGCTGGATCCGGCAGTCCCCAGGGAAGGGACTGGAGTGGATTGGGTTT

ATCTATTACGGTGGAAACACCAAGTACAATCCCTCCCTCAAGAGCCGCGT

CACCATATCACAAGACACTTCCAAGAGTCAGGTCTCCCTGACGATGAGCT

CTGTGACCGCTGCGGAATCGGCCGTCTATTTCTGTGCGAGAGCGTCTTGT

AGTGGTGGTTACTGTATCCTTGACTACTGGGGCCAGGGAACCCTGGTCAC

CGTCTCG

TCN-032 (8I10) VH amino acid sequence:
Kabat Bold, Chothia underlined
(SEQ ID NO: 44)
Q V Q L Q E S G P G L V K P S E T L S L T C T V S <u>G S S I S</u> N Y Y W S W I R Q S P G K G L E W I G F I Y Y <u>G G N T K</u> Y N P S L

K S R V T I S Q D T S K S Q V S L T M S S

V T A A E S A V Y F C A R <u>A S C S G G Y C</u>

<u>I L D</u> Y W G Q G T L V T V S

TCN-032 (8I10) VH short nucleotide sequence:
(SEQ ID NO: 278)
CAGGTGCAATTGCAGGAGTCGGGCCCAGGACTGGTGAAGCCTTCGGAGAC

CCTGTCCCTCACCTGCACTGTCTCTGGTTCGTCCATCAGTAATTACTACT

GGAGCTGGATCCGGCAGTCCCCAGGGAAGGGACTGGAGTGGATTGGGTTT

ATCTATTACGGTGGAAACACCAAGTACAATCCCTCCCTCAAGAGCCGCGT

CACCATATCACAAGACACTTCCAAGAGTCAGGTCTCCCTGACGATGAGCT

CTGTGACCGCTGCGGAATCGGCCGTCTATTTCTGTGCGAGAGCGTCTTGT

AGTGGTGGTTACTGTATCCTTGACTACTGGGGCCAGGGAACCCTGGTCAC

CGT

TCN-032 (8I10) VH short amino acid sequence:
Kabat Bold, Chothia underlined
(SEQ ID NO: 277)
Q V Q L Q E S G P G L V K P S E T L S L T C T V S <u>G S S I S</u> N Y Y W S W I R Q S P G K G L E W I G F I Y Y <u>G G N T K</u> Y N P S L

K S R V T I S Q D T S K S Q V S L T M S S

V T A A E S A V Y F C A R <u>A S C S G G Y C</u>

<u>I L D</u> Y W G Q G T L V T

TCN-032 (8I10) VH long nucleotide sequence:
(SEQ ID NO: 196)
CAGGTGCAATTGCAGGAGTCGGGCCCAGGACTGGTGAAGCCTTCGGAGAC

CCTGTCCCTCACCTGCACTGTCTCTGGTTCGTCCATCAGTAATTACTACT

GGAGCTGGATCCGGCAGTCCCCAGGGAAGGGACTGGAGTGGATTGGGTTT

ATCTATTACGGTGGAAACACCAAGTACAATCCCTCCCTCAAGAGCCGCGT

CACCATATCACAAGACACTTCCAAGAGTCAGGTCTCCCTGACGATGAGCT

CTGTGACCGCTGCGGAATCGGCCGTCTATTTCTGTGCGAGAGCGTCTTGT

AGTGGTGGTTACTGTATCCTTGACTACTGGGGCCAGGGAACCCTGGTCAC

CGTCTCGAGC

TCN-032 (8I10) VH long amino acid sequence:
Kabat Bold, Chothia underlined
(SEQ ID NO: 276)
Q V Q L Q E S G P G L V K P S E T L S L T C T V S <u>G S S I S</u> N Y Y W S W I R Q S P G K G L E W I G F I Y Y <u>G G N T K</u> Y N P S L

K S R V T I S Q D T S K S Q V S L T M S S

V T A A E S A V Y F C A R A S C S G G Y C

I L D Y W G Q G T L V T V S S

TCN-032 (8I10) VL nucleotide sequence:
(SEQ ID NO: 45)
GACATCCAGATGACCCAGTCTCCATCCTCCCTGTCTGCATCTGTAGGAGA

CAGAGTCACCATCACTTGCCGGGCGAGTCAGAACATTTACAAGTATTTAA

ATTGGTATCAGCAGAGACCAGGGAAAGCCCCTAAGGGCCTGATCTCTGCT

GCATCCGGGTTGCAAAGTGGGGTCCCATCAAGGTTCAGTGGCAGTGGATC

TGGGACAGATTTCACTCTCACCATCACCAGTCTGCAACCTGAAGATTTTG

CAACTTACTACTGTCAACAGAGTTACAGTCCCCCTCTCACTTTCGGCGGA

GGGACCAGGGTGGAGATCAAAC

TCN-032 (8I10) VL amino acid sequence:
Kabat Bold, Chothia underlined
(SEQ ID NO: 46)
D I Q M T Q S P S S L S A S V G D R V T I

T C R A S Q N I Y K Y L N W Y Q Q R P G K

A P K G L I S A A S G L Q S G V P S R F S

G S G S G T D F T L T I T S L Q P E D F A

T Y Y C Q Q S Y S P P L T F G G G T R V E

I K

The 21B15 antibody includes a heavy chain variable region (SEQ ID NO: 44) encoded by the nucleic acid sequence shown below in SEQ ID NO: 47, a short heavy chain variable region (SEQ ID NO: 277) encoded by the nucleic acid sequence shown below in SEQ ID NO: 278, a long heavy chain variable region (SEQ ID NO: 276) encoded by the nucleic acid sequence shown below in SEQ ID NO: 196, and a light chain variable region (SEQ ID NO: 46) encoded by the nucleic acid sequence shown in SEQ ID NO: 48.

The amino acids encompassing the CDRs as defined by Chothia et al. 1989, are underlined and those defined by Kabat et al., 1991 are highlighted in bold in the sequences below.

The heavy chain CDRs of the 21B15 antibody have the following sequences per Kabat definition: NYYWS (SEQ ID NO: 72), FIYYGGNTKYNPSLKS (SEQ ID NO: 74) and ASCSGGYCILD (SEQ ID NO: 76). The light chain CDRs of the 21B15 antibody have the following sequences per Kabat definition: RASQNIYKYLN (SEQ ID NO: 59), AASGLQS (SEQ ID NO: 61) and QQSYSPPLT (SEQ ID NO: 63).

The heavy chain CDRs of the 21 B 15 antibody have the following sequences per Chothia definition: GSSISN (SEQ ID NO: 109), FIYYGGNTK (SEQ ID NO: 110) and ASCSGGYCILD (SEQ ID NO: 76). The light chain CDRs of the 21B15 antibody have the following sequences per Chothia definition: RASQNIYKYLN (SEQ ID NO: 59), AASGLQS (SEQ ID NO: 61) and QQSYSPPLT (SEQ ID NO: 63).

21B15 VH nucleotide sequence:
(SEQ ID NO: 47)
CAGGTGCAATTGCAGGAGTCGGGCCCAGGACTGGTGAAGCCTTCGGAGAC

CCTGTCCCTCACCTGCACTGTCTCTGGTTCGTCCATCAGTAATTACTACT

GGAGCTGGATCCGGCAGTCCCCAGGGAAGGGACTGGAGTGGATTGGGTTT

ATCTATTACGGTGGAAACACCAAGTACAATCCCTCCCTCAAGAGCCGCGT

CACCATATCACAAGACACTTCCAAGAGTCAGGTCTCCCTGACGATGAGCT

CTGTGACCGCTGCGGAATCGGCCGTCTATTTCTGTGCGAGAGCGTCTTGT

AGTGGTGGTTACTGTATCCTTGACTACTGGGGCCAGGGAACCCTGGTCAC

CGTCTCG

21B15 VH amino acid sequence:
(SEQ ID NO: 44)
Kabat Bold, Chothia underlined
Q V Q L Q E S G P G L V K P S E T L S L T

C T V S G S S I S N Y Y W S W I R Q S P G

K G L E W I G F I Y Y G G N T K Y N P S L

K S R V T I S Q D T S K S Q V S L T M S S

V T A A E S A V Y F C A R A S C S G G Y C

I L D Y W G Q G T L V T V S

21B15 VH short nucleotide sequence:
(SEQ ID NO: 278)
CAGGTGCAATTGCAGGAGTCGGGCCCAGGACTGGTGAAGCCTTCGGAGAC

CCTGTCCCTCACCTGCACTGTCTCTGGTTCGTCCATCAGTAATTACTACT

GGAGCTGGATCCGGCAGTCCCCAGGGAAGGGACTGGAGTGGATTGGGTTT

ATCTATTACGGTGGAAACACCAAGTACAATCCCTCCCTCAAGAGCCGCGT

CACCATATCACAAGACACTTCCAAGAGTCAGGTCTCCCTGACGATGAGCT

CTGTGACCGCTGCGGAATCGGCCGTCTATTTCTGTGCGAGAGCGTCTTGT

AGTGGTGGTTACTGTATCCTTGACTACTGGGGCCAGGGAACCCTGGTCAC

CGT

21B15 VH short amino acid sequence:
(SEQ ID NO: 277)
Kabat Bold, Chothia underlined
Q V Q L Q E S G P G L V K P S E T L S L T

C T V S G S S I S N Y Y W S W I R Q S P G

K G L E W I G F I Y Y G G N T K Y N P S L

K S R V T I S Q D T S K S Q V S L T M S S

V T A A E S A V Y F C A R A S C S G G Y C

I L D Y W G Q G T L V T

21B15 VH long nucleotide sequence:
(SEQ ID NO: 196)
CAGGTGCAATTGCAGGAGTCGGGCCCAGGACTGGTGAAGCCTTCGGAGAC

CCTGTCCCTCACCTGCACTGTCTCTGGTTCGTCCATCAGTAATTACTACT

GGAGCTGGATCCGGCAGTCCCCAGGGAAGGGACTGGAGTGGATTGGGTTT

ATCTATTACGGTGGAAACACCAAGTACAATCCCTCCCTCAAGAGCCGCGT

CACCATATCACAAGACACTTCCAAGAGTCAGGTCTCCCTGACGATGAGCT

CTGTGACCGCTGCGGAATCGGCCGTCTATTTCTGTGCGAGAGCGTCTTGT

AGTGGTGGTTACTGTATCCTTGACTACTGGGGCCAGGGAACCCTGGTCAC

CGTCTCGAGC

21B15 VH long amino acid sequence:
(SEQ ID NO: 276)
Kabat Bold, Chothia underlined
Q V Q L Q E S G P G L V K P S E T L S L T

C T V S G S S I S N Y Y W S W I R Q S P G

```
K G L E W I G F I Y Y G G N T K Y N P S L

K S R V T I S Q D T S K S Q V S L T M S S

V T A A E S A V Y F C A R A S C S G G Y C

I L D Y W G Q G T L V T V S S
```

21B15 VL nucleotide sequence:
(SEQ ID NO: 48)
```
GACATCCAGGTGACCCAGTCTCCATCCTCCCTGTCTGCATCTGTAGGAGA

CAGAGTCACCATCACTTGCCGCGCGAGTCAGAACATTTACAAGTATTTAA

ATTGGTATCAGCAGAGACCAGGGAAAGCCCCTAAGGGCCTGATCTCTGCT

GCATCCGGGTTGCAAAGTGGGGTCCCATCAAGGTTCAGTGGCAGTGGATC

TGGGACAGATTTCACTCTCACCATCACCAGTCTGCAACCTGAAGATTTTG

CAACTTACTACTGTCAACAGAGTTACAGTCCCCCTCTCACTTTCGGCGGA

GGGACCAGGGTGGATATCAAAC
```

21B15 VL amino acid sequence:
(SEQ ID NO: 292)
Kabat Bold, Chothia underlined
```
D I Q V T Q S P S S L S A S V G D R V T I

T C R A S Q N I Y K Y L N W Y Q Q R P G K

A P K G L I S A A S G L Q S G V P S R F S

G S G S G T D F T L T I T S L Q P E D F A

T Y Y C Q Q S Y S P P L T F G G G T R V D

I K
```

The TCN-031 (23K12) antibody includes a heavy chain variable region (SEQ ID NO: 50) encoded by the nucleic acid sequence shown below in SEQ ID NO: 49, a short heavy chain variable region (SEQ ID NO: 236) encoded by the nucleic acid sequence shown below in SEQ ID NO: 244, a long heavy chain variable region (SEQ ID NO: 195) encoded by the nucleic acid sequence shown below in SEQ ID NO: 235, and a light chain variable region (SEQ ID NO: 52) encoded by the nucleic acid sequence shown in SEQ ID NO: 51.

The amino acids encompassing the CDRs as defined by Chothia et al., 1989 are underlined and those defined by Kabat et al., 1991 are highlighted in bold in the sequences below.

The heavy chain CDRs of the TCN-031 (23K12) antibody have the following sequences per Kabat definition: SNYMS (SEQ ID NO: 103), VIYSGGSTYYADSVK (SEQ ID NO: 105) and CLSRMRGYGLDV (SEQ ID NO: 107). The light chain CDRs of the TCN-031 (23K12) antibody have the following sequences per Kabat definition: RTSQSISSYLN (SEQ ID NO: 92), AASSLQSGVPSRF (SEQ ID NO: 94) and QQSYSMPA (SEQ ID NO: 96).

The heavy chain CDRs of the TCN-031 (23K12) antibody have the following sequences per Chothia definition: GFTVSSN (SEQ ID NO: 112), VIYSGGSTY (SEQ ID NO: 113) and CLSRMRGYGLDV (SEQ ID NO: 107). The light chain CDRs of the TCN-031 (23K12) antibody have the following sequences per Chothia definition: RTSQSISSYLN (SEQ ID NO: 92), AASSLQSGVPSRF (SEQ ID NO: 94) and QQSYSMPA (SEQ ID NO: 96).

TCN-031 (23K12) VH nucleotide sequence:
(SEQ ID NO: 49)
```
GAGGTGCAGCTGGTGGAGTCTGGGGGAGGCTTGGTCCAGCCTGGGGGGTC

CCTGAGAATCTCCTGTGCAGCCTCTGGATTCACCGTCAGTAGCAACTACA

TGAGTTGGGTCCGCCAGGCTCCAGGGAAGGGGCTGGAGTGGGTCTCAGTT

ATTTATAGTGGTGGTAGCACATACTACGCAGACTCCGTGAAGGGCAGATT

CTCCTTCTCCAGAGACAACTCCAAGAACACAGTGTTTCTTCAAATGAACA

GCCTGAGAGCCGAGGACACGGCTGTGTATTACTGTGCGAGATGTCTGAGC

AGGATGCGGGGTTACGGTTTAGACGTCTGGGGCCAAGGGACCACGGTCAC

CGTCTCG
```

TCN-031 (23K12) VH amino acid sequence:
(SEQ ID NO: 50)
Kabat Bold, Chothia underlined
```
E V Q L V E S G G G L V Q P G G S L R I S

C A A S G F T V S S N Y M S W V R Q A P G

K G L E W V S V I Y S G G S T Y Y A D S V

K G R F S F S R D N S K N T V F L Q M N S

L R A E D T A V Y Y C A R C L S R M R G Y

G L D V W G Q G T T V T V S
```

TCN-031 (23K12) VH short nucleotide sequence:
(SEQ ID NO: 244)
```
GAGGTGCAGCTGGTGGAGTCTGGGGGAGGCTTGGTCCAGCCTGGGGGGTC

CCTGAGAATCTCCTGTGCAGCCTCTGGATTCACCGTCAGTAGCAACTACA

TGAGTTGGGTCCGCCAGGCTCCAGGGAAGGGGCTGGAGTGGGTCTCAGTT

ATTTATAGTGGTGGTAGCACATACTACGCAGACTCCGTGAAGGGCAGATT

CTCCTTCTCCAGAGACAACTCCAAGAACACAGTGTTTCTTCAAATGAACA

GCCTGAGAGCCGAGGACACGGCTGTGTATTACTGTGCGAGATGTCTGAGC

AGGATGCGGGGTTACGGTTTAGACGTCTGGGGCCAAGGGACCACGGTCAC

CGT
```

TCN-031 (23K12) VH short amino acid sequence:
(SEQ ID NO: 236)
Kabat Bold, Chothia underlined
```
E V Q L V E S G G G L V Q P G G S L R I S

C A A S G F T V S S N Y M S W V R Q A P G

K G L E W V S V I Y S G G S T Y Y A D S V

K G R F S F S R D N S K N T V F L Q M N S

L R A E D T A V Y Y C A R C L S R M R G Y

G L D V W G Q G T T V T V S
```

TCN-031 (23K12) VH long nucleotide sequence:
(SEQ ID NO: 195)
```
GAGGTGCAGCTGGTGGAGTCTGGGGGAGGCTTGGTCCAGCCTGGGGGGTC

CCTGAGAATCTCCTGTGCAGCCTCTGGATTCACCGTCAGTAGCAACTACA

TGAGTTGGGTCCGCCAGGCTCCAGGGAAGGGGCTGGAGTGGGTCTCAGTT

ATTTATAGTGGTGGTAGCACATACTACGCAGACTCCGTGAAGGGCAGATT

CTCCTTCTCCAGAGACAACTCCAAGAACACAGTGTTTCTTCAAATGAACA

GCCTGAGAGCCGAGGACACGGCTGTGTATTACTGTGCGAGATGTCTGAGC
```

-continued

```
AGGATGCGGGGTTACGGTTTAGACGTCTGGGGCCAAGGGACCACGGTCAC

CGTCTCGAGC

TCN-031 (23K12) VH long amino acid sequence:
                                    (SEQ ID NO: 235)
Kabat Bold, Chothia underlined
E V Q L V E S G G G L V Q P G G S L R I S

C A A S G F T V S S N Y M S W V R Q A P G

K G L E W V S V I Y S G G S T Y Y A D S V

K G R F S F S R D N S K N T V F L Q M N S

L R A E D T A V Y Y C A R C L S R M R G Y

G L D V W G Q G T T V T V S S

TCN-031 (23K12) VL nucleotide sequence:
                                    (SEQ ID NO: 51)
GACATCCAGATGACCCAGTCTCCATCCTCCCTGTCTGCATCTGTAGGAGA

CAGAGTCACCATCACTTGCCGGACAAGTCAGAGCATTAGCAGCTATTTAA

ATTGGTATCAGCAGAAACCAGGGAAAGCCCCTAAACTCCTGATCTATGCT

GCATCCAGTTTGCAAAGTGGGGTCCCATCAAGGTTCAGTGGCAGTGGATC

TGGGACAGATTTCACTCTCACCATCAGCGGTCTGCAACCTGAAGATTTTG

CAACCTACTACTGTCAACAGAGTTACAGTATGCCTGCCTTTGGCCAGGGG

ACCAAGCTGGAGATCAAA

TCN-031 (23K12) VL amino acid sequence:
                                    (SEQ ID NO: 52)
Kabat Bold, Chothia underlined
D I Q M T Q S P S S L S A S V G D R V T I

T C R T S Q S I S S Y L N W Y Q Q K P G K

A P K L L I Y A A S S L Q S G V P S R F S

G S G S G T D F T L T I S G L Q P E D F A

T Y Y C Q Q S Y S M P A F G Q G T K L E I

K
```

The 3241_G23 antibody (also referred to herein as G23) includes a heavy chain variable region (SEQ ID NO: 116) encoded by the nucleic acid sequence shown below in SEQ ID NO: 115, and a light chain variable region (SEQ ID NO: 118) encoded by the nucleic acid sequence shown in SEQ ID NO: 117.

The amino acids encompassing the CDRs as defined by Chothia et al., 1989 are underlined and those defined by Kabat et al., 1991 are highlighted in bold in the sequences below.

The heavy chain CDRs of the G23 antibody have the following sequences per Kabat definition: GGGYSWN (SEQ ID NO: 179), FMFHSGSPRYNPTLKS (SEQ ID NO: 180) and VGQMDKYYAMDV (SEQ ID NO: 181). The light chain CDRs of the G23 antibody have the following sequences per Kabat definition: RASQSIGAYVN (SEQ ID NO: 184), GASNLQS (SEQ ID NO: 185) and QQTYSTPIT (SEQ ID NO: 186).

The heavy chain CDRs of the G23 antibody have the following sequences per Chothia definition: GGPVSGGG (SEQ ID NO: 182), FMFHSGSPR (SEQ ID NO: 183) and VGQMDKYYAMDV (SEQ ID NO: 181). The light chain CDRs of the G23 antibody have the following sequences per Chothia definition: RASQSIGAYVN (SEQ ID NO: 184), GASNLQS (SEQ ID NO: 185) and QQTYSTPIT (SEQ ID NO: 186).

```
3241_G23 VH nucleotide sequence
                                    (SEQ ID NO: 115)
CAGGTGCAGCTGCAGCAGTCGGGCCCAGGACTGGTGAAGCCTTCACAGAC

CCTGTCCCTCACTTGCACTGTCTCTGGTGGCCCCGTCAGCGGTGGTGGTT

ACTCCTGGAACTGGATCCGCCAACGCCCAGGACAGGGCCTGGAGTGGGTT

GGGTTCATGTTTCACAGTGGGAGTCCCCGCTACAATCCGACCCTCAAGAG

TCGAATTACCATCTCAGTCGACACGTCTAAGAACCTGGTCTCCCTGAAGC

TGAGCTCTGTGACGGCCGCGGACACGGCCGTGTATTTTTGTGCGCGAGTG

GGGCAGATGGACAAGTACTATGCCATGGACGTCTGGGGCCAAGGGACCAC

GGTCACCGTCTCGAGC

3241_G23 VH amino acid sequence
                                    (SEQ ID NO: 116)
Kabat Bold, Chothia underlined
QVQLQQSGPGLVKPSQTLSLTCTVSGGPVSGGGYSWNWIRQRPGQGLEWV

GFMFHSGSPRYNPTLKSRITISVDTSKNLVSLKLSSVTAADTAVYFCARV

GQMDKYYAMDVWGQGTTVTVSS

3241_G23 VL nucleotide sequence
                                    (SEQ ID NO: 117)
GACATCCAGATGACCCAGTCTCCATCCTCCCTGTCTTCCTCTGTCGGAGA

CAGAGTCACCATCACTTGCCGGGCAAGTCAGAGCATTGGCGCCTATGTAA

ATTGGTATCAACAGAAAGCAGGGAAAGCCCCCCAGGTCCTGATCTTTGGT

GCTTCCAATTTACAAAGCGGGGTCCCATCAAGGTTCAGTGGCAGTGGATC

TGGGACAGATTTCACTCTCACCATCAGCAGTCTGCAACCTGAAGACTTTG

CAACTTACTTCTGTCAACAGACTTACAGTACCCCGATCACCTTCGGCCAA

GGGACACGACTGGAGATTAAACG

3241_G23 VL amino acid sequence
                                    (SEQ ID NO: 118)
Kabat Bold, Chothia underlined
DIQMTQSPSSLSSSVGDRVTITCRASQSIGAYVNWYQQKAGKAPQVLIFG

ASNLQSGVPSRFSGSGSGTDFTLTISSLQPEDFATYFCQQTYSTPITFGQ

GTRLEIK
```

The 3244_I10 antibody (also referred to herein as I10) includes a heavy chain variable region (SEQ ID NO: 120) encoded by the nucleic acid sequence shown below in SEQ ID NO: 119, and a light chain variable region (SEQ ID NO: 122) encoded by the nucleic acid sequence shown in SEQ ID NO: 121.

The amino acids encompassing the CDRs as defined by Chothia et al., 1989 are underlined and those defined by Kabat et al., 1991 are highlighted in bold in the sequences below.

The heavy chain CDRs of the I10 antibody have the following sequences per Kabat definition: SDYWS (SEQ ID NO: 187), FFYNGGSTKYNPSLKS (SEQ ID NO: 188) and HDAKFSGSYYVAS (SEQ ID NO: 189). The light chain CDRs of the I10 antibody have the following sequences per Kabat definition: RASQSISTYLN (SEQ ID NO: 192), GATNLQS (SEQ ID NO: 193) and QQSYNTPLI (SEQ ID NO: 194).

The heavy chain CDRs of the I10 antibody have the following sequences per Chothia definition: GGSITS (SEQ ID NO: 190), FFYNGGSTK (SEQ ID NO: 191) and HDAKFSGSYYVAS (SEQ ID NO: 189). The light chain CDRs of the I10 antibody have the following sequences per Chothia definition: RASQSISTYLN (SEQ ID NO: 192), GATNLQS (SEQ ID NO: 193) and QQSYNTPLI (SEQ ID NO: 194).

3244_I10 VH nucleotide sequence
(SEQ ID NO: 119)
CAGGTCCAGCTGCAGGAGTCGGGCCCAGGACTGCTGAAGCCTTCGGACAC

CCTGGCCCTCACTTGCACTGTCTCTGGTGGCTCCATCACCAGTGACTACT

GGAGCTGGATCCGGCAACCCCCAGGGAGGGGACTGGACTGGATCGGATTC

TTCTATAACGGCGGAAGCACCAAGTACAATCCCTCCCTCAAGAGTCGAGT

CACCATTTCAGCGGACACGTCCAAGAACCAGTTGTCCCTGAAATTGACCT

CTGTGACCGCCGCAGACACGGGCGTGTATTATTGTGCGAGACATGATGCC

AAATTTAGTGGGAGCTACTACGTTGCCTCCTGGGGCCAGGGAACCCGAGT

CACCGTCTCGAGC

3244_I10 VH amino acid sequence
(SEQ ID NO: 120)
QVQLQESGPGLLKPSDTLALTCTVS<u>GGSITS</u>DYWSWIRQPPGRGLDWIGF

FYNGGSTKYNPSLKSRVTISADTSKNQLSLKLTSVTAADTGVYYCARHDA

KFSGSYYVASWGQGTRVTVSS

3244_I10 VL nucleotide sequence
(SEQ ID NO: 121)
GACATCCAGATGACCCAGTCTCCATCCTCCCTGTCTGCATCTGTAGGAGA

CAGAGTCACCATCTCTTGCCGGGCAAGTCAGAGCATTAGCACCTATTTAA

ATTGGTATCAGCAGCAACCTGGGAAAGCCCCTAAGGTCCTCATTTTTGGT

GCAACCAACTTGCAAAGTGGGGTCCCATCTCGCTTCAGTGGCAGTGGATC

TGGGACAGATTTCACTCTCACCATCAGCAGTCTGCAACCTGAAGATTTTG

CAACTTACTACTGTCAACAGAGTTACAATACCCCCCTCATTTTTGGCCAG

GGGACCAAGCTGGAGATCAAACG

3244_I10 VL amino acid sequence
(SEQ ID NO: 122)
DIQMTQSPSSLSASVGDRVTISCRASQSISTYLNWYQQQPGKAPKVLIFG

ATNLQSGVPSRFSGSGSGTDFTLTISSLQPEDFATYYCQQSYNTPLIFGQ

GTKLEIK

3243_J07 VH nucleotide sequence
(SEQ ID NO: 123)
CAGGTCCAGCTGCAGGAGTCGGGCCCAGGACTGCTGAAGCCTTCGGACAC

CCTGGCCCTCACTTGCACTGTCTCTGGTGGCTCCATCACCAGTGACTACT

GGAGCTGGATCCGGCAACCCCCAGGGAGGGGACTGGACTGGATCGGATTC

TTCTATAACGGCGGGAGCACCAAGTACAATCCCTCCCTCAAGAGTCGAGT

CACCATATCAGCGGACACGTCCAAGAACCAGTTGTCCCTGAAATTGACCT

CTGTGACCGCCGCAGACACGGGCGTGTATTATTGTGCGAGACATGATGTC

AAATTTAGTGGGAGCTACTACGTTGCCTCCTGGGGCCAGGGAACCCGAGT

CACCGTCTCGAGC

3243_J07 VH amino acid sequence
(SEQ ID NO: 124)
QVQLQESGPGLLKPSDTLALTCTVS<u>GGSITS</u>DYWSWIRQPPGRGLDWIGF

FYNGGSTKYNPSLKSRVTISADTSKNQLSLKLTSVTAADTGVYYCARHDV

KFSGSYYVASWGQGTRVTVSS

3243_J07 VL nucleotide sequence
(SEQ ID NO: 125)
GACATCCAGATGACCCAGTCTCCATCCTCCCTGTCTGCATCTGTAGGAGA

CAGAGTCACCATCTCTTGCCGGGCAAGTCAGAGCATTAGCACCTATTTAA

ATTGGTATCAGCAGCAACCTGGGAAAGCCCCTAAGGTCCTGATCTCTGGT

GCAACCAACTTGCAAAGTGGGGTCCCATCTCGCTTCAGTGGCAGTGGATC

TGGGACAGATTTCACTCTCACCATCAGCAGTCTGCAACCTGAAGATTTTG

CAACTTACTACTGTCAACAGAGTTACAATACCCCCCTCATTTTTGGCCAG

GGGACCAAGCTGGAGATCAAACG

3243_J07 VL amino acid sequence
(SEQ ID NO: 126)
DIQMTQSPSSLSASVGDRVTISCRASQSISTYLNWYQQQPGKAPKVLISG

ATNLQSGVPSRFSGSGSGTDFTLTISSLQPEDFATYYCQQSYNTPLIFGQ

GTKLEIK

The 3243_J07 antibody (also referred to herein as J07) includes a heavy chain variable region (SEQ ID NO: 124) encoded by the nucleic acid sequence shown below in SEQ ID NO: 123, and a light chain variable region (SEQ ID NO: 126) encoded by the nucleic acid sequence shown in SEQ ID NO: 125.

The amino acids encompassing the CDRs as defined by Chothia et al., 1989 are underlined and those defined by Kabat et al., 1991 are highlighted in bold in the sequences below.

The heavy chain CDRs of the J07 antibody have the following sequences per Kabat definition: SDYWS (SEQ ID NO: 187), FFYNGGSTKYNPSLKS (SEQ ID NO: 188) and HDVKFSGSYYVAS (SEQ ID NO: 197). The light chain CDRs of the J07 antibody have the following sequences per Kabat definition: RASQSISTYLN (SEQ ID NO: 192), GATNLQS (SEQ ID NO: 193) and QQSYNTPLI (SEQ ID NO: 194).

The heavy chain CDRs of the J07 antibody have the following sequences per Chothia definition: GGSITS (SEQ ID NO: 190), FFYNGGSTK (SEQ ID NO: 191) and HDVKF-SGSYYVAS (SEQ ID NO: 197). The light chain CDRs of the J07 antibody have the following sequences per Chothia definition: RASQSISTYLN (SEQ ID NO: 192), GATNLQS (SEQ ID NO: 193) and QQSYNTPLI (SEQ ID NO: 194).

The 3259_J21 antibody (also referred to herein as J21) includes a heavy chain variable region (SEQ ID NO: 128) encoded by the nucleic acid sequence shown below in SEQ ID NO: 127, and a light chain variable region (SEQ ID NO: 130) encoded by the nucleic acid sequence shown in SEQ ID NO: 129.

The amino acids encompassing the CDRs as defined by Chothia et al., 1989 are underlined and those defined by Kabat et al., 1991 are highlighted in bold in the sequences below.

The heavy chain CDRs of the J21 antibody have the following sequences per Kabat definition: SYNWI (SEQ ID NO: 203), HIYDYGRTFYNSSLQS (SEQ ID NO: 204) and PLGILHYYAMDL (SEQ ID NO: 205). The light chain CDRs of the J21 antibody have the following sequences per Kabat definition: RASQSIDKFLN (SEQ ID NO: 208), GASNLHS (SEQ ID NO: 209) and QQSFSVPA (SEQ ID NO: 210).

The heavy chain CDRs of the J21 antibody have the following sequences per Chothia definition: GGSISS (SEQ ID NO: 206), HIYDYGRTF (SEQ ID NO: 207) and PLGIL-HYYAMDL (SEQ ID NO: 205). The light chain CDRs of the J21 antibody have the following sequences per Chothia definition: RASQSIDKFLN (SEQ ID NO: 208), GASNLHS (SEQ ID NO: 209) and QQSFSVPA (SEQ ID NO: 210).

3259_J21 VH nucleotide sequence
(SEQ ID NO: 127)
CAGGTGCAGCTGCAGGAGTCGGGCCCACGAGTGGTGAGGCCTTCGGAGAC

CCTGTCCCTCACCTGCACTGTCTCGGGGGGCTCCATCAGTTCTTACAACT

GGATTTGGATCCGGCAGCCCCCTGGGAAGGGACTGGAGTGGATTGGGCAC

ATATATGACTATGGGAGGACCTTCTACAACTCCTCCCTCCAGAGTCGACC

TACCATATCTGTAGACGCGTCCAAGAATCAGCTCTCCCTGCGATTGACCT

CTGTGACCGCCTCAGACACGGCCGTCTATTACTGTGCGAGACCTCTCGGT

ATACTCCACTACTACGCGATGGACCTCTGGGGCCAAGGGACCACGGTCAC

CGTCTCGAGC

3259_J21 VH amino acid sequence
(SEQ ID NO: 128)
QVQLQESGPRVVRPSETLSLTCTVS<u>GGSISSYNWI</u>WIRQPPGKGLEWIGH

IYDYGRTFYNSSLQSRPTISVDASKNQLSLRLTSVTASDTAVYYCAR<u>PLG</u>

<u>ILHYYAMDL</u>WGQGTTVTVSS

3259_J21 VL nucleotide sequence
(SEQ ID NO: 129)
GACATCCAGATGACCCAGTCTCCATTATCCGTGTCTGTATCTGTCGGGGA

CAGGGTCACCATCGCTTGCCGGGCAAGTCAGAGTATTGACAAGTTTTTAA

ATTGGTATCAGCAGAAACCAGGGAAAGCCCCTAAACTCCTGATCTATGGT

GCCTCCAATTTGCACAGTGGGGCCCCATCAAGGTTCAGTGCCAGTGGGTC

TGGGACAGACTTCACTCTAACAATCACCAATATACAGACTGAAGATTTCG

CAACTTACCTCTGTCAACAGAGTTTCAGTGTCCCCGCTTTCGGCGGAGGG

ACCAAGGTTGAGATCAAACG

3259_J21 VL amino acid sequence
(SEQ ID NO: 130)
DIQMTQSPLSVSVSVGDRVTIAC<u>RASQSIDKFLN</u>WYQQKPGKAPKLLIY<u>G</u>

<u>ASNLHS</u>GAPSRFSASGSGTDFTLTITNIQTEDFATYLCQQSFSVPAFGGG

TKVEIK

3245_O19 VH nucleotide sequence
(SEQ ID NO: 131)
GAGGTGCAACTGGTGGAGTCTGGAGGGGGCTTGGTCCAGCCTGGGGGGTC

CCTGAGACTCTCCTGTACGGCCTCTGGGTTAAGTGTCAGTTCCACCTACA

TGAACTGGGTCCGCCAGGCTCCAGGGAAGGGGCTGGAATGGGTCTCAGTT

TTTTATAGTGAGACCAGGACGTACTACGCAGACTCCGTGAAGGGCCGATT

CACCGTCTCCAGACACAATTCCAACAACACGCTCTATCTTCAGATGAACA

GCCTGAGAGTTGAAGACACGGCCGTGTATTATTGTGCGAGAGTCCAGAGA

TTGTCGTACGGTATGGACGTCTGGGGCCAAGGGACCACGGTCACCGTCTC

GAGC

3245_O19 VH amino acid sequence
(SEQ ID NO: 132)
EVQLVESGGGLVQPGGSLRLSCTAS<u>GLSVSSTYMN</u>WVRQAPGKGLEWVS<u>V</u>

<u>FYSETRTYYADSVKGR</u>FTVSRHNSNNTLYLQMNSLRVEDTAVYYCAR<u>VQR</u>

<u>LSYGMDV</u>WGQGTTVTVSS

3245_O19 VL nucleotide sequence
(SEQ ID NO: 133)
GACATCCAGATGACCCAGTCTCCATCCTCCCTGTCTGCATCTGTTGGAGA

CAGAGTCACCATCACTTGCCGGGCAAGTCAGAGCATTAGCACCTATTTAA

ATTGGTATCAGAAGAGACCAGGGAAAGCCCCTAAACTCCTGGTCTATGGT

GCATCCACTTTGCAGAGTGGGGTCCCATCAAGGTTCAGTGGCAGTGGATC

TGGGACAGATTTCACTCTCACCATCGCCAGTCTGCAACCTGAAGATTCTG

CAACTTACTACTGTCAACAGACTTACAGTATCCCCCTCTTCGGCCAGGGG

ACACGGCTGGAGATTAAACG

3245_O19 VL amino acid sequence
(SEQ ID NO: 134)
DIQMTQSPSSLSASVGDRVTITC<u>RASQSISTYLN</u>WYQKRPGKAPKLLVY<u>G</u>

<u>ASTLQS</u>GVPSRFSGSGSGTDFTLTIASLQPEDSATYYCQQTYSIPLFGQG

TRLEIK

The 3245_O19 antibody (also referred to herein as O19) includes a heavy chain variable region (SEQ ID NO: 132) encoded by the nucleic acid sequence shown below in SEQ ID NO: 131, and a light chain variable region (SEQ ID NO: 134) encoded by the nucleic acid sequence shown in SEQ ID NO: 133.

The amino acids encompassing the CDRs as defined by Chothia et al., 1989 are underlined and those defined by Kabat et al., 1991 are highlighted in bold in the sequences below.

The heavy chain CDRs of the O19 antibody have the following sequences per Kabat definition: STYMN (SEQ ID NO: 211), VFYSETRTYYADSVKG (SEQ ID NO: 212) and VQRLSYGMDV (SEQ ID NO: 213). The light chain CDRs of the O19 antibody have the following sequences per Kabat definition: RASQSISTYLN (SEQ ID NO: 192), GASTLQS (SEQ ID NO: 217) and QQTYSIPL (SEQ ID NO: 218).

The heavy chain CDRs of the O19 antibody have the following sequences per Chothia definition: GLSVSS (SEQ ID NO: 214), VFYSETRTY (SEQ ID NO: 215) and VQRLSYGMDV (SEQ ID NO: 213). The light chain CDRs of the O19 antibody have the following sequences per Chothia definition: RASQSISTYLN (SEQ ID NO: 192), GASTLQS (SEQ ID NO: 217) and QQTYSIPL (SEQ ID NO: 218).

The 3244_H04 antibody (also referred to herein as H04) includes a heavy chain variable region (SEQ ID NO: 136) encoded by the nucleic acid sequence shown below in SEQ ID NO: 135, and a light chain variable region (SEQ ID NO: 138) encoded by the nucleic acid sequence shown in SEQ ID NO: 137.

The amino acids encompassing the CDRs as defined by Chothia et al., 1989 are underlined and those defined by Kabat et al., 1991 are highlighted in bold in the sequences below.

The heavy chain CDRs of the H04 antibody have the following sequences per Kabat definition: STYMN (SEQ ID NO: 211), VFYSETRTYYADSVKG (SEQ ID NO: 212) and VQRLSYGMDV (SEQ ID NO: 213). The light chain CDRs of the H04 antibody have the following sequences per Kabat definition: RASQSISTYLN (SEQ ID NO: 192), GASSLQS (SEQ ID NO: 226) and QQTYSIPL (SEQ ID NO: 218).

The heavy chain CDRs of the H04 antibody have the following sequences per Chothia definition: GLSVSS (SEQ ID NO: 214), VFYSETRTY (SEQ ID NO: 215) and VQRLSYGMDV (SEQ ID NO: 213). The light chain CDRs of the H04 antibody have the following sequences per Chothia definition: RASQSISTYLN (SEQ ID NO: 192), GASSLQS (SEQ ID NO: 226) and QQTYSIPL (SEQ ID NO: 218).

3244_H04 VH nucleotide sequence
(SEQ ID NO: 135)
GAGGTGCAGCTGGTGGAATCTGGAGGGGGCTTGGTCCAGCCTGGGGGGTC

CCTGAGACTCTCCTGTACAGCCTCTGGGTTAAGCGTCAGTTCCACCTACA

TGAACTGGGTCCGCCAGGCTCCAGGGAAGGGGCTGGAATGGGTCTCAGTT

TTTTATAGTGAAACCAGGACGTATTACGCAGACTCCGTGAAGGGCCGATT

CACCGTCTCCAGACACAATTCCAACAACACGCTGTATCTTCAAATGAACA

GCCTGAGAGCTGAAGACACGGCCGTGTATTATTGTGCGAGAGTCCAGAGA

CTGTCATACGGTATGGACGTCTGGGGCCAAGGGACCACGGTCACCGTCTC

GAGC

3244_H04 VH amino acid sequence
(SEQ ID NO: 136)
EVQLVESGGGLVQPGGSLRLSCTAS<u>GLSVS</u>STYMNWVRQAPGKGLEWVS<u>V FYSETRTYYADSVKG</u>RFTVSRHNSNNTLYLQMNSLRAEDTAVYYCAR<u>VQR LSYGMDV</u>WGQGTTVTVSS 3244_H04 VL nucleotide sequence
(SEQ ID NO: 137)
GACATCCAGATGACCCAGTCTCCATCGTCCCTGTCTGCATCTGTAGGAGA

CAGAGTCACCATCACTTGCCGGGCAAGTCAGAGCATTAGCACCTATTTAA

ATTGGTATCAGAAGAGACCAGGGAAAGCCCCTAAACTCCTGGTCTATGGT

GCATCCAGTTTGCAGAGTGGGGTCCCATCAAGGTTCAGTGGCAGTGGATC

TGGGACAGATTTCACTCTCACCATCGCCAGTCTGCAACCTGAAGATTCTG

CAGTTTATTACTGTCAACAGACTTACAGTATCCCCCTCTTCGGCCAGGGG

ACACGACTGGAGATTAAACG

3244_H04 VL amino acid sequence
(SEQ ID NO: 138)
DIQMTQSPSSLSASVGDRVTITC<u>RASQSISTYLN</u>WYQKRPGKAPKLLVY<u>G

ASSLQS</u>GVPSRFSGSGSGTDFTLTIASLQPEDSAVYYC<u>QQTYSIPL</u>FGQG

TRLEIK

3136_G05 VH nucleotide sequence
(SEQ ID NO: 139)
CAGGTGCAGCTGCAGGAGTCGGGCCCAGGACTGGTGAAGCCCTCGGAGAC

CCTGTCCCTCACCTGCAGTGTCTCTGGTGGCTCCATTAGTAGTGATTTCT

GGAGTTGGATCCGACAGCCCCCAGGGAAGGGACTGGAGTGGATTGGGTAT

GTCTATAACAGAGGGAGCACTAAGTACAGTCCCTCCCTCAAGAGTCGAGT

CACCATATCAGCAGACATGTCCAAGAACCAGTTTTCCCTGAATATGAGTT

CTGTGACCGCTGCGGACACGGCCGTGTATTACTGTGCGAAAAATGGTCGA

AGTAGCACCAGTTGGGGCATCGACGTCTGGGGCAAAGGGACCACGGTCAC

CGTCTCGAGC

3136_G05 VH amino acid sequence
(SEQ ID NO: 140)
QVQLQESGPGLVKPSETLSLTCSVS<u>GGSISS</u>SDFWSWIRQPPGKGLEWIG<u>Y VYNRGSTKYSPSLKS</u>RVTISADMSKNQFSLNMSSVTAADTAVYYCAK<u>NGR SSTSWGIDV</u>WGKGTTVTVSS 3136_G05 VL nucleotide sequence
(SEQ ID NO: 141)
GACATCCAGATGACCCAGTCTCCATCCTCCCTGTCTGCATCTGTGGGAGA

CAGACTCACCATCACTTGCCGGGCAAGTCAGAGCATTAGCACCTATTTAC

ATTGGTATCAGCAGAAACCAGGGAAAGCCCCTAAACTCCTGATCTATGCT

GCATCCAGTTTGCAAAGTGGGGTCCCATCAAGGTTCAGTGGCAGTAGATC

AGGAACAGATTTCACTCTCACCATCAGCAGTCTGCAACCTGATGACTTTG

CAACTTACTACTGTCAACAGAGTTACAGTCCCCCCCTCACTTTCGGCCCT

GGGACCAAAGTGGATATGAAACG

3136_G05 VL amino acid sequence
(SEQ ID NO: 142)
DIQMTQSPSSLSASVGDRLTITC<u>RASQSISTYLH</u>WYQQKPGKAPKLLIY<u>A

ASSLQS</u>GVPSRFSGSRSGTDFTLTISSLQPDDFATYYC<u>QQSYSPPLT</u>FGP

GTKVDMK

The 3136_G05 antibody (also referred to herein as G05) includes a heavy chain variable region (SEQ ID NO: 140) encoded by the nucleic acid sequence shown below in SEQ ID NO: 139, and a light chain variable region (SEQ ID NO: 142) encoded by the nucleic acid sequence shown in SEQ ID NO: 141.

The amino acids encompassing the CDRs as defined by Chothia et al., 1989 are underlined and those defined by Kabat et al., 1991 are highlighted in bold in the sequences below.

The heavy chain CDRs of the G05 antibody have the following sequences per Kabat definition: SDFWS (SEQ ID NO: 228), YVYNRGSTKYSPSLKS (SEQ ID NO: 229) and NGRSSTSWGIDV (SEQ ID NO: 230). The light chain CDRs of the 3136_G05 antibody have the following sequences per Kabat definition: RASQSISTYLH (SEQ ID NO: 233), AASSLQS (SEQ ID NO: 234) and QQSYSPPLT (SEQ ID NO: 63).

The heavy chain CDRs of the 3136_G05 antibody have the following sequences per Chothia definition: GGSISS (SEQ ID NO: 206), YVYNRGSTK (SEQ ID NO: 232) and NGRSSTSWGIDV (SEQ ID NO: 230). The light chain CDRs of the 3136_G05 antibody have the following sequences per Chothia definition: RASQSISTYLH (SEQ ID NO: 233), AASSLQS (SEQ ID NO: 234) and QQSYSPPLT (SEQ ID NO: 63).

The 3252_C13 antibody (also referred to herein as C13) includes a heavy chain variable region (SEQ ID NO: 144) encoded by the nucleic acid sequence shown below in SEQ ID NO: 143, and a light chain variable region (SEQ ID NO: 146) encoded by the nucleic acid sequence shown in SEQ ID NO: 145.

The amino acids encompassing the CDRs as defined by Chothia et al., 1989 are underlined and those defined by Kabat et al., 1991 are highlighted in bold in the sequences below.

The heavy chain CDRs of the C13 antibody have the following sequences per Kabat definition: SDYWS (SEQ ID NO: 187), YIYNRGSTKYTPSLKS (SEQ ID NO: 237) and HVGGHTYGIDY (SEQ ID NO: 238). The light chain CDRs of the C13 antibody have the following sequences per Kabat definition: RASQSISNYLN (SEQ ID NO: 241), AASSLQS (SEQ ID NO: 234) and QQSYNTPIT (SEQ ID NO: 243).

The heavy chain CDRs of the C13 antibody have the following sequences per Chothia definition: GASISS (SEQ ID NO: 239), YIYNRGSTK (SEQ ID NO: 240) and HVGGHTYGIDY (SEQ ID NO: 238). The light chain CDRs of the C13 antibody have the following sequences per Chothia definition: RASQSISNYLN (SEQ ID NO: 241), AASSLQS (SEQ ID NO: 234) and QQSYNTPIT (SEQ ID NO: 243).

3252_C13 VH nucleotide sequence
(SEQ ID NO: 143)
CAGGTGCAGCTGCAGGAGTCGGGCCCAGGACTGGTGAAGCCTTCGGAGAC

CCTGTCCCTCACCTGCACTGTCTCTGGTGCCTCCATCAGTAGTGACTACT

GGAGCTGGATCCGGCTGCCCCCAGGGAAGGGACTGGAGTGGATTGGGTAT

ATCTATAATAGAGGGAGTACCAAGTACACCCCCTCCCTGAAGAGTCGAGT

CACCATATCACTAGACACGGCCGAGAACCAGTTCTCCCTGAGGCTGAGGT

CGGTGACCGCCGCAGACACGGCCATCTATTACTGTGCGAGACATGTAGGT

GGCCACACCTATGGAATTGATTACTGGGGCCAGGGAACCCTGGTCACCGT

CTCGAGC

3252_C13 VH amino acid sequence
(SEQ ID NO: 144)
QVQLQESGPGLVKPSETLSLTCTVS<u>GASISS</u>SDYWSWIRLPPGKGLEWIGY

IYNRGSTKYTPSLKSRVTISLDTAENQFSLRLRSVTAADTAIYYCARHVG

GHTYGIDYWGQGTLVTVSS

3252_C13 VL nucleotide sequence
(SEQ ID NO: 145)
GACATCCAGATGACCCAGTCTCCATCGTCCCTGTCTGCCTCTGTAGGAGA

CAGAGTCACCATCACTTGCCGGGCAAGTCAGAGCATTAGCAACTATTTAA

ATTGGTATCAACACAAACCTGGGGAAGCCCCCAAGCTCCTGAACTATGCT

GCGTCCAGTTTGCAAAGTGGGGTCCCATCAAGGTTCAGTGCCAGTGGATC

TGGGACAGATTTCACTCTCACCATCAGCAGTCTTCAACCTGAAGATTTTG

CCACTTACTACTGTCAACAGAGTTACAATACTCCGATCACCTTCGGCCAA

GGGACACGACTGGAAATTAAACG

3252_C13 VL amino acid sequence
(SEQ ID NO: 146)
DIQMTQSPSSLSASVGDRVTITCRASQSISNYLNWYQHKPGEAPKLLNYA

ASSLQSGVPSRFSASGSGTDFTLTISSLQPEDFATYYCQQSYNTPITFGQ

GTRLEIK

3255_J06 VH nucleotide sequence
(SEQ ID NO: 147)
CAGGTGCAGCTGCAGGAGTCGGGCCCAGGACTGGTGAAGCCTTCGGAGAC

CCTGTCCCTCACCTGCACTGTCTCTGGTGCCTCCATCAGTAGTGACTACT

GGAGCTGGATCCGGCTGCCCCCAGGGAAGGGACTGGAGTGGATTGGGTAT

ATCTATAATAGAGGGAGTACCAAGTACACCCCCTCCCTGAAGAGTCGAGT

CACCATATCACTAGACACGGCCGAGAACCAGTTCTCCCTGAGGCTGAGGT

CGGTGACCGCCGCAGACACGGCCGTCTATTACTGTGCGAGACATGTGGGT

GGCCACACCTATGGAATTGATTACTGGGGCCAGGGAACCCTGGTCACCGT

CTCGAGC

3255_J06 VH amino acid sequence
(SEQ ID NO: 148)
QVQLQESGPGLVKPSETLSLTCTVS<u>GASISS</u>SDYWSWIRLPPGKGLEWIGY

IYNRGSTKYTPSLKSRVTISLDTAENQFSLRLRSVTAADTAVYYCARHVG

GHTYGIDYWGQGTLVTVSS

3255_J06 VL nucleotide sequence
(SEQ ID NO: 149)
GACATCCAGATGACCCAGTCTCCATCGTCCCTGTCTGCCTCTGTAGGAGA

CAGAGTCACCATCACTTGCCGGGCAAGTCAGAGCATTAGCAACTATTTAA

ATTGGTATCAACACAAACCTGGGGAAGCCCCCAAGCTCCTGAACTATGCT

GCGTCCAGTTTGCAAAGTGGGGTCCCATCAAGGTTCAGTGCCAGTGGATC

TGGGACAGATTTCACTCTCAGCATCAGCGGTCTTCAACCTGAAGATTTTG

CCACTTACTACTGTCAACAGAGCTACAATACTCCGATCACCTTCGGCCCA

GGGACACGACTGGAAATTAAACG

3255_J06 VL amino acid sequence
(SEQ ID NO: 150)
DIQMTQSPSSLSASVGDRVTITCRASQSISNYLNWYQHKPGEAPKLLNYA

ASSLQSGVPSRFSASGSGTDFTLSISGLQPEDFATYYCQQSYNTPITFGP

GTRLEIK

The 3259_J06 antibody (also referred to herein as J06) includes a heavy chain variable region (SEQ ID NO: 148) encoded by the nucleic acid sequence shown below in SEQ ID NO: 147, and a light chain variable region (SEQ ID NO: 150) encoded by the nucleic acid sequence shown in SEQ ID NO: 149.

The amino acids encompassing the CDRs as defined by Chothia et al., 1989 are underlined and those defined by Kabat et al., 1991 are highlighted in bold in the sequences below.

The heavy chain CDRs of the J06 antibody have the following sequences per Kabat definition: SDYWS (SEQ ID NO: 187), YIYNRGSTKYTPSLKS (SEQ ID NO: 237) and HVGGHTYGIDY (SEQ ID NO: 238). The light chain CDRs of the J06 antibody have the following sequences per Kabat definition: RASQSISNYLN (SEQ ID NO: 241), AASSLQS (SEQ ID NO: 234) and QQSYNTPIT (SEQ ID NO: 243).

The heavy chain CDRs of the J06 antibody have the following sequences per Chothia definition: GASISS (SEQ ID NO: 239), YIYNRGSTK (SEQ ID NO: 240) and HVGGHTYGIDY (SEQ ID NO: 238). The light chain CDRs of the J06 antibody have the following sequences per Chothia definition: RASQSISNYLN (SEQ ID NO: 241), AASSLQS (SEQ ID NO: 234) and QQSYNTPIT (SEQ ID NO: 243).

The 3410_I23 antibody (also referred to herein as I23) includes a heavy chain variable region (SEQ ID NO: 152) encoded by the nucleic acid sequence shown below in SEQ ID NO: 151, and a light chain variable region (SEQ ID NO: 154) encoded by the nucleic acid sequence shown in SEQ ID NO: 153.

The amino acids encompassing the CDRs as defined by Chothia et al., 1989 are underlined and those defined by Kabat et al., 1991 are highlighted in bold in the sequences below.

The heavy chain CDRs of the 3410_I23 antibody have the following sequences per Kabat definition: SYSWS (SEQ ID NO: 252), YLYYSGSTKYNPSLKS (SEQ ID NO: 253) and TGSESTTGYGMDV (SEQ ID NO: 254). The light chain CDRs of the 3410_I23 antibody have the following sequences per Kabat definition: RASQSISTYLN (SEQ ID NO: 192), AASSLHS (SEQ ID NO: 258) and QQSYSPPIT (SEQ ID NO: 259).

The heavy chain CDRs of the 3410_I23 antibody have the following sequences per Chothia definition: GDSISS (SEQ ID NO: 255), YLYYSGSTK (SEQ ID NO: 256) and TGSESTTGYGMDV (SEQ ID NO: 254). The light chain CDRs of the 3410_I23 antibody have the following sequences per Chothia definition: RASQSISTYLN (SEQ ID NO: 192), AASSLHS (SEQ ID NO: 258) and QQSYSPPIT (SEQ ID NO: 259).

3420_I23 VH nucleotide sequence
(SEQ ID NO: 151)
CAGGTGCAGCTGCAGGAGTCGGGCCCAGGACTGGTGAAGCCTTCGGAGAC

CCTGTCCGTCACCTGCAAAGTCTCTGGTGACTCCATCAGTAGTTATTCCT

GGAGCTGGATCCGGCAGCCCCCAGGGAAGGGACTGGAGTGGGTTGGCTAT

TTGTATTATAGTGGGAGCACCAAGTACAACCCCTCCCTCAAGAGTCGAAC

CACCATATCAGTAGACACGTCCACGAACCAGTTGTCCCTGAAGTTGAGTT

TTGTGACCGCCGCGGACACGGCCGTGTATTTCTGTGCGAGAACCGGCTCG

GAATCTACTACCGGCTACGGTATGGACGTCTGGGGCCAAGGGACCACGGT

CACCGTCTCGAGC

3420_I23 VH amino acid sequence
(SEQ ID NO: 152)
QVQLQESGPGLVKPSETLSVTCKVS<u>GDSIS</u>SYSWSWIRQPPGKGLEWVGY

<u>LYYSGSTKYNPSLKS</u>RTTISVDTSTNQLSLKLSFVTAADTAVYFCAR<u>TGS</u>

<u>ESTTGYGMDV</u>WGQGTTVTVSS

3420_I23 VL nucleotide sequence
(SEQ ID NO: 153)
GACATCCAGATGACCCAGTCTCCATCCTCCCTGTCTGCATCTGTAGGAGA

CAGAGTCACCATCACTTGCCGGGCAAGTCAGAGCATTAGCACCTATTTAA

ATTGGTATCAGCAGAAACCAGGGAAAGCCCCTAAGCTCCTGATCTATGCT

GCATCCAGTTTGCACAGTGGGGTCCCATCAAGGTTCAGTGGCAGTGGATC

TGGGACAGATTTCGCTCTCACCATCAGCAGTCTGCAACCTGAAGATTTTG

CAACTTACTACTGTCAACAGAGTTACAGTCCCCCGATCACCTTCGGCCAA

GGGACACGACTGGAGATTAAACG

3420_I23 VL amino acid sequence
(SEQ ID NO: 154)
DIQMTQSPSSLSASVGDRVTITC<u>RASQSISTYLN</u>WYQQKPGKAPKLLIY<u>A</u>

<u>ASSLHS</u>GVPSRFSGSGSGTDFALTISSLQPEDFATYYC<u>QQSYSPPIT</u>FGQ

GTRLEIK

3139_P23 VH nucleotide sequence
(SEQ ID NO: 155)
CAGGTGCAGCTGCAGGAGTCGGGCCCAAGACTGGTGAAGCCTTCGGAGAG

CCTGTCCCTCACCTGCACTGTCTCTGGTGGCTCCATTAGTAATTCCTTCT

GGGGCTGGATCCGGCAGCCCCCAGGGGAGGGACTGGAGTGGATTGGTTAT

GTCTATAACAGTGGCAACACCAAGTACAATCCCTCCCTCAAGAGTCGAGT

CACCATTTCGCGCGACACGTCCAAGAGTCAACTCTACATGAAGCTGAGGT

CTGTGACCGCCGCTGACACGGCCGTGTACTACTGTGCGAGGCATGACGAC

GCAAGTCATGGCTACAGCATCTCCTGGGGCCACGGAACCCTGGTCACCGT

CTCGAGC

3139_P23 VH amino acid sequence
(SEQ ID NO: 156)
QVQLQESGPRLVKPSESLSLTCTVS<u>GGSISN</u>NSFWGWIRQPPGEGLEWIGY

<u>VYNSGNTKYNPSLKS</u>RVTISRDTSKSQLYMKLRSVTAADTAVYYCAR<u>HDD</u>

<u>ASHGYSIS</u>WGHGTLVTVSS

3139_P23 VL nucleotide sequence
(SEQ ID NO: 157)
GACATCCAGATGACCCAGTCTCCATCCTCCCTGTCTGCATCTGTAGGGGA

CAGAGTCACCATCACTTGCCGGGCAAGTCAGACCATTAGTACTTATTTAA

ATTGGTATCAACAGAAATCAGGGAAAGCCCCTAAGCTCCTGATCTATGCT

GCATCCGGTTTGCAAAGTGGAGTCCCATCAAGGTTCAGTGGCAGTGGATC

TGGGACAGATTTCACTCTCACCATCAGCAGTCTTCAACCTGAAGATTTTG

CAACTTACTTCTGTCAACAGAGTTACAATACTCCCCTGACGTTCGGCCAA

GGGACCAAGGTGGAAATCAAA

3139_P23 VL amino acid sequence
(SEQ ID NO: 158)
DIQMTQSPSSLSASVGDRVTITC<u>RASQTISTYLN</u>WYQQKSGKAPKLLIY<u>A</u>

<u>ASGLQS</u>GVPSRFSGSGSGTDFTLTISSLQPEDFATYFC<u>QQSYNTPLT</u>FGQ

GTKVEIK

The 3139_P23 antibody (also referred to herein as P23) includes a heavy chain variable region (SEQ ID NO: 156) encoded by the nucleic acid sequence shown below in SEQ ID NO: 155, and a light chain variable region (SEQ ID NO: 158) encoded by the nucleic acid sequence shown in SEQ ID NO:157.

The amino acids encompassing the CDRs as defined by Chothia et al., 1989 are underlined and those defined by Kabat et al., 1991 are highlighted in bold in the sequences below.

The heavy chain CDRs of the P23 antibody have the following sequences per Kabat definition: NSFWG (SEQ ID NO: 260), YVYNSGNTKYNPSLKS (SEQ ID NO: 261) and HDDASHGYSIS (SEQ ID NO: 262). The light chain CDRs of the 3139_P23 antibody have the following sequences per Kabat definition: RASQTISTYLN (SEQ ID NO: 265), AASGLQS (SEQ ID NO: 61) and QQSYNTPLT (SEQ ID NO: 267).

The heavy chain CDRs of the 3139_P23 antibody have the following sequences per Chothia definition: GGSISN (SEQ ID NO: 263), YVYNSGNTK (SEQ ID NO: 264) and HDDASHGYSIS (SEQ ID NO: 262). The light chain CDRs of the 3139_P23 antibody have the following sequences per Chothia definition: RASQTISTYLN (SEQ ID NO: 265), AASGLQS (SEQ ID NO: 61) and QQSYNTPLT (SEQ ID NO: 267).

The 3248_P18 antibody (also referred to herein as P18) includes a heavy chain variable region (SEQ ID NO: 160) encoded by the nucleic acid sequence shown below in SEQ ID NO: 159, and a light chain variable region (SEQ ID NO: 162) encoded by the nucleic acid sequence shown in SEQ ID NO: 161.

The amino acids encompassing the CDRs as defined by Chothia et al., 1989 are underlined and those defined by Kabat et al., 1991 are highlighted in bold in the sequences below.

The heavy chain CDRs of the 3248_P18 antibody have the following sequences per Kabat definition: AYHWS (SEQ ID NO: 268), HIFDSGSTYYNPSLKS (SEQ ID NO: 269) and PLGSRYYYGMDV (SEQ ID NO: 270). The light chain CDRs of the 3248_P18 antibody have the following sequences per Kabat definition: RASQSISRYLN (SEQ ID NO: 273), GASTLQN (SEQ ID NO: 274) and QQSYSVPA (SEQ ID NO: 275).

The heavy chain CDRs of the 3248_P18 antibody have the following sequences per Chothia definition: GGSISA (SEQ ID NO: 271), HIFDSGSTY (SEQ ID NO: 272) and PLGSRYYYGMDV (SEQ ID NO: 270). The light chain CDRs of the 3248_P18 antibody have the following sequences per Chothia definition: RASQSISRYLN (SEQ ID NO: 273), GASTLQN (SEQ ID NO: 274) and QQSYSVPA (SEQ ID NO: 275).

3248_P18 VH nucleotide sequence
(SEQ ID NO: 159)
CAGGTGCAACTGCAGGAGTCGGGCCCAGGACTGGTGAAGCCTTCGGAGAC

CCTGTCCCTCACCTGCACTGTCTCGGGTGGCTCCATCAGTGCTTACCACT

GGAGCTGGATCCGCCAGCCCCCAGGGAAGGGACTGGAGTGGATTGGGCAC

ATCTTTGACAGTGGGAGCACTTACTACAACCCCTCCCTTAAGAGTCGAGT

CACCATATCACTAGACGCGTCCAAGAACCAGCTCTCCCTGAGATTGACCT

CTGTGACCGCCTCAGACACGGCCATATATTACTGTGCGAGACCTCTCGGG

AGTCGGTACTATTACGGAATGGACGTCTGGGGCCAAGGGACCACGGTCAC

CGTCTCGAGC

3248_P18 VH amino acid sequence
(SEQ ID NO: 160)
QVQLQESGPGLVKPSETLSLTCTVS<u>GGSISAYHWS</u>WIRQPPGKGLEWIGH

IFDSGSTYYNPSLKSRVTISLDASKNQLSLRLTSVTASDTAIYYCARPLG

SRYYYGMDVWGQGTTVTVSS

3248_P18 VL nucleotide sequence
(SEQ ID NO: 161)
GACATCCAGATGACCCAGTCTCCGTCCTCCCTGTCTGCATCTGTCGGAGA

CAGAGTCACCATCACTTGCCGGGCAAGTCAGAGTATTAGCAGGTATTTAA

ATTGGTATCAGCAGAAACCAGGGAAAGCCCCTAAGCTCCTGATCTATGGT

GCCTCCACTTTGCAAAATGGGGCCCCATCAAGGTTCAGCGGCAGTGGATC

TGGGACAGATTTCACTCTCACCATCAGCAGTCTACAACCTGAAGATTCCG

CAACTTACCTCTGTCAACAGAGTTACAGTGTCCCTGCTTTCGGCGGAGGA

ACCAAGGTGGAGGTCAAA

3248_P18 VL amino acid sequence (SEQ ID NO: 162)
DIQMTQSPSSLSASVGDRVTITCRASQSISRYLNWYQQKPGKAPKLLIYG

ASTLQNGAPSRFSGSGSGTDFTLTISSLQPEDSATYLCQQSYSVPAFGGG

TKVEVK

3253_P10 VH nucleotide sequence
(SEQ ID NO: 163)
CAGGTCCAGCTGCAGGAGTCGGGCCCAGGACTGCTGAAGCCTTCGGACAC

CCTGGCCCTCACTTGCACTGTCTCTGGTGGCTCCATCACCAGTGACTACT

GGAGCTGGATCCGGCAACCCCCAGGGAGGGGACTGGACTGGATCGGATTC

TTCTATAACGGCGGGAGCACCAAGTACAATCCCTCCCTCAAGAGTCGAGT

CACCATATCAGCGGACACGTCCAAGAACCAGTTGTCCCTGAAATTGACCT

CTGTGACCGCCGCAGACACGGGCGTGTATTATTGTGCGAGACATGATGCC

AAATTTAGTGGGAGCTACTACGTTGCCTCCTGGGGCCAGGGAACCCGAGT

CACCGTCTCGAGC

3253_P10 VH amino acid sequence
(SEQ ID NO: 164)
QVQLQESGPGLLKPSDTLALTCTVS<u>GGSITSDYWS</u>WIRQPPGRGLDWIGF

FYNGGSTKYNPSLKSRVTISADTSKNQLSLKLTSVTAADTGVYYCARHDA

KFSGSYYVASWGQGTRVTVSS

3253_P10 VL nucleotide sequence
(SEQ ID NO: 165)
GACATCCAGATGACCCAGTCTCCCTCCTCCCTGTCTGCATCTGTAGGAGA

CAGAGTCACCATCTCTTGCCGGGCAAGTCAGAGCATTAGCACCTATTTAA

ATTGGTATCAGCAGCAACCTGGGAAAGCCCCTAAGGTCCTGATCTCTGGT

GCAACCGACTTGCAAAGTGGGGTCCCATCTCGCTTCAGTGGCAGTGGATC

TGGGACAGATTTCACTCTCACCATCAGCAGTCTGCAACCTGAAGATTTTG

CAACTTACTACTGTCAACAGAGTTACAATACCCCCCTCATTTTTGGCCAG

GGGACCAAGCTGGAGATCAAA

3253_P10 VL amino acid sequence
(SEQ ID NO: 166)
DIQMTQSPSSLSASVGDRVTISCRASQSISTYLNWYQQQPGKAPKVLIS<u>G</u>

<u>ATDLQS</u>GVPSRFSGSGSGTDFTLTISSLQPEDFATYYCQQSYNTPLIFGQ

GTKLEIK

The 3253_P10 antibody (also referred to herein as P10) includes a heavy chain variable region (SEQ ID NO: 164) encoded by the nucleic acid sequence shown below in SEQ ID NO: 163, and a light chain variable region (SEQ ID NO: 166) encoded by the nucleic acid sequence shown in SEQ ID NO: 165.

The amino acids encompassing the CDRs as defined by Chothia et al., 1989 are underlined and those defined by Kabat et al., 1991 are highlighted in bold in the sequences below.

The heavy chain CDRs of the 3253_P10 antibody have the following sequences per Kabat definition: SDYWS (SEQ ID NO: 187), FFYNGGSTKYNPSLKS (SEQ ID NO: 188) and HDAKFSGSYYVAS (SEQ ID NO: 189). The light chain CDRs of the 3253_P10 antibody have the following sequences per Kabat definition: RASQSISTYLN (SEQ ID NO: 192), GATDLQS (SEQ ID NO: 282) and QQSYNTPLI (SEQ ID NO: 194).

The heavy chain CDRs of the 3253_P10 antibody have the following sequences per Chothia definition: GGSITS (SEQ ID NO: 190), FFYNGGSTK (SEQ ID NO: 191) and HDAKFSGSYYVAS (SEQ ID NO: 189). The light chain CDRs of the 3253_P10 antibody have the following sequences per Chothia definition: RASQSISTYLN (SEQ ID NO: 192), GATDLQS (SEQ ID NO: 282) and QQSYNTPLI (SEQ ID NO: 194).

The 3260_D19 antibody (also referred to herein as D19) includes a heavy chain variable region (SEQ ID NO: 168) encoded by the nucleic acid sequence shown below in SEQ ID NO: 167, and a light chain variable region (SEQ ID NO: 170) encoded by the nucleic acid sequence shown in SEQ ID NO: 169.

The amino acids encompassing the CDRs as defined by Chothia et al., 1989 are underlined and those defined by Kabat et al., 1991 are highlighted in bold in the sequences below.

The heavy chain CDRs of the 3260_D19 antibody have the following sequences per Kabat definition: DNYIN (SEQ ID NO: 284), VFYSADRTSYADSVKG (SEQ ID NO: 285) and VQKSYYGMDV (SEQ ID NO: 286). The light chain CDRs of the 3260_D19 antibody have the following sequences per Kabat definition: RASQSISRYLN (SEQ ID NO: 273), GASSLQS (SEQ ID NO: 226) and QQTFSIPL (SEQ ID NO: 291).

The heavy chain CDRs of the 3260_D19 antibody have the following sequences per Chothia definition: GFSVSD (SEQ ID NO: 287), VFYSADRTS (SEQ ID NO: 288) and VQKSYYGMDV (SEQ ID NO: 286). The light chain CDRs of the 3260_D19 antibody have the following sequences per Chothia definition: RASQSISRYLN (SEQ ID NO: 273), GASSLQS (SEQ ID NO: 226) and QQTFSIPL (SEQ ID NO: 291).

3260_D19 VH nucleotide sequence
(SEQ ID NO: 167)
GACATGCAGCTGGTGGAGTCTGGAGGAGGCTTGGTCCCGCCGGGGGGT

CCCTGAGACTCTCCTGCGCAGCCTCTGGGTTTTCCGTCAGTGACAACTA

CATAAACTGGGTCCGCCAGGCTCCAGGGAAGGGGCTGGACTGGGTCTCA

GTCTTTTATAGTGCTGATAGAACATCCTACGCAGACTCCGTGAAGGGCC

GATTCACCGTCTCCAGCCACGATTCCAAGAACACAGTGTACCTTCAAAT

GAACAGTCTGAGAGCTGAGGACACGGCCGTTTATTACTGTGCGAGAGTT

CAGAAGTCCTATTACGGTATGGACGTCTGGGGCCAAGGGACCACGGTCA

CCGTCTCGAGC

3260_D19 VH amino acid sequence
(SEQ ID NO: 168)
DMQLVESGGGLVPPGGSLRLSCAASGFSVSDNYINWVRQAPGKGLDWVS

VFYSADRTSYADSVKGRFTVSSHDSKNTVYLQMNSLRAEDTAVYYCAR

VQKSYYGMDVWGQGTTVTSS

3260_D19 VL nucleotide sequence
(SEQ ID NO: 169)
GGCATCCAGATGACCCAGTCTCCATCCTCCCTGTCTGCATCTGTAGGAG

ACAGAGTCACCATCACTTGCCGGGCAAGTCAGAGCATTAGCAGATATTT

AAATTGGTATCTGCAGAAACCAGGGAAAGCCCCTAAGCTCCTGATCTCT

GGTGCATCCAGTTTGCAAAGTGGGGTCCCATCAAGGTTCAGTGGCACTG

GGTCTGGGACAGAATTCACTCTCACCATCAGCAGTTTGCAACCTGAAGA

TTTTGCAACTTACTACTGTCAACAGACTTTCAGTATCCCTCTTTTTGGC

CAGGGGACCAAGGTGGAGATCAAA

3260_D19 VL amino acid sequence
(SEQ ID NO: 170)
GIQMTQSPSSLSASVGDRVTITCRASQSISRYLNWYLQKPGKAPKLLIS

GASSLQSGVPSRFSGTGSGTEFTLTISSLQPEDFATYYCQQTFSIPLFG

QGTKVEIK

3362_B11 VH nucleotide sequence
(SEQ ID NO: 171)
CAGGTGCAGCTGCAGGCGTCGGGCCCAGGACTGGTGAAGCCTTCAGAGA

CCCTGTCCCTCACCTGCACTGTCTCTGGTGACTCCATCACCAGTGGTGC

TTACTACTGGACCTGGATCCGCCAGCACCCAGGGAAGGGCCTGGAGTGG

ATTGGGTACATCTATTACAGTGGGAACACCTACTACAACCCGTCCCTCA

AGAGTCGAGTTACCATATCACTAGACACGTCTAAGAACCAGTTCTCCCT

GAAGGTGAACTCTGTGACTGCCGCGGACACGGCCGTATATTACTGTGCG

CGAGCTGCTTCGACTTCAGTGCTAGGATACGGTATGGACGTCTGGGGCC

AAGGGACCACGGTCACCGTCTCGAGC

3362_B11 VH amino acid sequence
(SEQ ID NO: 172)
QVQLQASGPGLVKPSETLSLTCTVSGDSITSGAYYWTWIRQHPGKGLEW

IGYIYYSGNTYYNPSLKSRVTISLDTSKNQFSLKVNSVTAADTAVYYCA

RAASTSVLGYGMDVWGQGTTVTSS

3362_B11 VL nucleotide sequence
(SEQ ID NO: 173)
GACATCCAGATGACCCAGTCTCCATCCTCCCTGTCTGCATCTGTAGGAG

ACAGAGTCACCATCACTTGCCGGGCAAGTCAGAGCATTAGCAGATATTT

AAATTGGTATCAGCAGGAACCAGGGAAGGCCCCTAAGCTCCTGGTCTAT

GCTGCATCCAGTTTGCAAAGTGGGGTCCCATCAAGGTTCAGTGGCAGTG

GATCTGGGACAGATTTCACTCTCACCATAAGCAGTCTTCAACCTGAAGA

TTTTGCAACTTACTACTGTCAACAGAGTTATAGTACCCCCCTCACCTTC

GGCCAAGGGACACGACTGGAGATTAAA

3362_B11 VH amino acid sequence
(SEQ ID NO: 174)
DIQMTQSPSSLSASVGDRVTITCRASQSISRYLNWYQQEPGKAPKLLVY

AASSLQSGVPSRFSGSGSGTDFTLTISSLQPEDFATYYCQQSYSTPLTF

GQGTRLEIK

The 3362_B11 antibody (also referred to herein as B11) includes a heavy chain variable region (SEQ ID NO: 172) encoded by the nucleic acid sequence shown below in SEQ ID NO: 171, and a light chain variable region (SEQ ID NO: 174) encoded by the nucleic acid sequence shown in SEQ ID NO: 173.

The amino acids encompassing the CDRs as defined by Chothia et al., 1989 are underlined and those defined by Kabat et al., 1991 are highlighted in bold in the sequences below.

The heavy chain CDRs of the B11 antibody have the following sequences per Kabat definition: SGAYYWT (SEQ ID NO: 293), YIYYSGNTYYNPSLKS (SEQ ID NO: 294) and AASTSVLGYGMDV (SEQ ID NO: 295). The light chain CDRs of the B11 antibody have the following sequences per Kabat definition: RASQSISRYLN (SEQ ID NO: 273), AASSLQS (SEQ ID NO: 234) and QQSYSTPLT (SEQ ID NO: 300).

The heavy chain CDRs of the B11 antibody have the following sequences per Chothia definition: GDSITSGA (SEQ ID NO: 296), YIYYSGNTY (SEQ ID NO: 297) and AASTS-VLGYGMDV (SEQ ID NO: 295). The light chain CDRs of the B11 antibody have the following sequences per Chothia definition: RASQSISRYLN (SEQ ID NO: 273), AASSLQS (SEQ ID NO: 234) and QQSYSTPLT (SEQ ID NO: 300).

The 3242_P05 antibody (also referred to herein as P05) includes a heavy chain variable region (SEQ ID NO: 176) encoded by the nucleic acid sequence shown below in SEQ ID NO: 175, and a light chain variable region (SEQ ID NO: 178) encoded by the nucleic acid sequence shown in SEQ ID NO: 177.

The amino acids encompassing the CDRs as defined by Chothia et al., 1989 are underlined and those defined by Kabat et al., 1991 are highlighted in bold in the sequences below.

The heavy chain CDRs of the 3242_P05 antibody have the following sequences per Kabat definition: VSDNYIN (SEQ ID NO: 301), VFYSADRTSYADSVKG (SEQ ID NO: 285) and VQKSYYGMDV (SEQ ID NO: 286). The light chain CDRs of the 3242_P05 antibody have the following sequences per Kabat definition: RASQSISRYLN (SEQ ID NO: 273), GASSLQS (SEQ ID NO: 226) and QQTFSIPL (SEQ ID NO: 291).

The heavy chain CDRs of the 3242_P05 antibody have the following sequences per Chothia definition: SGFSV (SEQ ID NO: 304), VFYSADRTS (SEQ ID NO: 288) and VQKSYYGMDV (SEQ ID NO: 286). The light chain CDRs of the 3242_P05 antibody have the following sequences per Chothia definition: The light chain CDRs of the 3242_P05 antibody have the following sequences per Kabat definition: RASQSISRYLN (SEQ ID NO: 273), GASSLQS (SEQ ID NO: 226) and QQTFSIPL (SEQ ID NO: 291).

3242_P05 VH nucleotide sequence
(SEQ ID NO: 175)
GACATGCAGCTGGTGGAGTCTGGAGGAGGCTTGGTCCCGCCGGGGGGT

CCCTGAGACTCTCCTGCGCAGCCTCTGGGTTTTCCGTCAGTGACAACTA

CATAAACTGGGTCCGCCAGGCTCCAGGGAAGGGGCTGGACTGGGTCTCA

GTCTTTTATAGTGCTGATAGAACATCCTACGCAGACTCCGTGAAGGGCC

GATTCACCGTCTCCAGCCACGATTCCAAGAACACAGTGTACCTTCAAAT

GAACAGTCTGAGAGCTGAGGACACGGCCGTTTATTACTGTGCGAGAGTT

CAGAAGTCCTATTACGGTATGGACGTCTGGGGCCAAGGGACCACGGTCA

CCGTCTCGAGC

_P05 VH amino acid sequence
(SEQ ID NO: 176)
DMQLVESGGGLVPPGGSLRLSCAASGFSVSDNYINWVRQAPGKGLDWVS

VFYSADRTSYADSVKGRFTVSSHDSKNTVYLQMNSLRAEDTAVYYCARV

QKSYYGMDVWGQGTTVTVSS

3242_P05 VL nucleotide sequence
(SEQ ID NO: 177)
GGCATCCAGATGACCCAGTCTCCATCCTCCCTGTCTGCATCTGTAGGAG

ACAGAGTCACCATCACTTGCCGGGCAAGTCAGAGCATTAGCAGATATTT

AAATTGGTATCTGCAGAAACCAGGGAAAGCCCCTAAGCTCCTGATCTCT

GGTGCATCCAGTTTGCAAAGTGGGGTCCCATCAAGGTTCAGTGGCACTG

GGTCTGGGACAGAATTCACTCTCACCATCAGCAGTTTGCAACCTGAAGA

TTTTGCAACTTACTACTGTCAACAGACTTTCAGTATCCCTCTTTTTGGC

CAGGGGACCAAGGTGGAGATCAAA

3242_P05 VL amino acid sequence
(SEQ ID NO: 178)
GIQMTQSPSSLSASVGDRVTITCRASQSISRYLNWYLQKPGKAPKLLIS

GASSLQSGVPSRFSGTGSGTEFTLTISSLQPEDFATYYCQQTFSIPLFG

QGTKVEIK

HuM2e antibodies of the invention also include antibodies that include a heavy chain variable amino acid sequence that is at least 90%, 92%, 95%, 97% 98%, 99% or more identical the amino acid sequence of SEQ ID NO: 44, 277, 276, 50, 236, 235, 116, 120, 124, 128, 132, 136, 140, 144, 148, 152, 156, 160, 164, 168, 172, or 176. and/or a light chain variable amino acid that is at least 90%, 92%, 95%, 97% 98%, 99% or more identical the amino acid sequence of SEQ ID NO: 46, 52, 118, 122, 126, 130, 134, 138, 142, 146, 150, 154, 158, 162, 166, 170, 174, 178.

Alternatively, the monoclonal antibody is an antibody that binds to the same epitope as TCN-032 (8I10), 21B15, TCN-031 (23K12), 3241_G23, 3244_I10, 3243_J07, 3259_J21, 3245_O19, 3244_H04, 3136_G05, 3252_C13, 3255_J06, 3420_I23, 3139_P23, 3248_P18, 3253_P10, 3260_D19, 3362_B11, or 3242_P05.

The heayy chain of a M2e antibody is derived from a germ line V (variable) gene such as, for example, the IgHV4 or the IgHV3 germline gene.

The M2e antibodies of the invention include a variable heavy chain ($V_H$) region encoded by a human IgHV4 or the IgHV3 germline gene sequence. An IgHV4 germline gene sequence is shown, e.g., in Accession numbers L10088, M29812, M95114, X56360 and M95117. An IgHV3 germline gene sequence is shown, e.g., in Accession numbers X92218, X70208, Z27504, M99679 and AB019437. The M2e antibodies of the invention include a $V_H$ region that is encoded by a nucleic acid sequence that is at least 80% homologous to the IgHV4 or the IgHV3 germline gene sequence. Preferably, the nucleic acid sequence is at least 90%, 95%, 96%, 97% homologous to the IgHV4 or the IgHV3 germline gene sequence, and more preferably, at least 98%, 99% homologous to the IgHV4 or the IgHV3 germline gene sequence. The $V_H$ region of the M2e antibody is at least 80% homologous to the amino acid sequence of the $V_H$ region encoded by the IgHV4 or the IgHV3 $V_H$ germline gene sequence. Preferably, the amino acid sequence of $V_H$ region of the M2e antibody is at least 90%, 95%, 96%, 97% homologous to the amino acid sequence encoded by the IgHV4 or the IgHV3 germline gene sequence, and more preferably, at least 98%, 99% homologous to the sequence encoded by the IgHV4 or the IgHV3 germline gene sequence. The M2e antibodies of the invention also include a variable light chain ($V_L$) region encoded by a human IgKV1 germline gene sequence. A human IgKV1 $V_L$ germline gene sequence is shown, e.g., Accession numbers X59315, X59312, X59318, J00248, and Y14865. Alternatively, the M2e antibodies include a $V_L$ region that is encoded by a nucleic acid sequence that is at least 80% homologous to the IgKV1 germline gene sequence. Preferably, the nucleic acid sequence is at least 90%, 95%, 96%, 97% homologous to the IgKV1 germline gene sequence, and more preferably, at least 98%, 99% homologous to the IgKV1 germline gene sequence. The $V_L$ region of the M2e antibody is at least 80% homologous to the amino acid sequence of the $V_L$ region encoded the IgKV1 germline gene sequence. Preferably, the amino acid sequence of $V_L$ region of the M2e antibody is at least 90%, 95%, 96%, 97% homologous to the amino acid sequence encoded by the IgKV1 germline gene sequence, and more preferably, at least 98%, 99% homologous to the sequence encoded by e the IgKV1 germline gene sequence.

HA Antibodies I

The HA antibodies of the invention may also be capable of specifically binding to one or more fragments of influenza virus H5N1, such as the surface glycoproteins, hemagglutinin (HA) and neuraminidase (NA), which are required for viral attachment and cellular release, or membrane proteins (M1 and M2). In a specific embodiment, the HA antibodies of the invention are capable of specifically binding to the HA molecule of H5N1 strains. They may be capable of specifically binding to the HA1 and/or HA2 subunit of the HA molecule. They may be capable of specifically binding to linear or structural and/or conformational epitopes on the HA1 and/or HA2 subunit of the HA molecule. The HA molecule may be purified from viruses or recombinantly produced and optionally isolated before use. Alternatively, HA may be expressed on the surface of cells.

For diagnostic purposes, the HA antibodies may also be capable of specifically binding to proteins not present on the surface of H5N1 including the nucleoprotein, the nucleocapsid structural protein, polymerases (PA, PB and PB2), and non-structural proteins (NS1 and NS2). The nucleotide and/or amino acid sequence of proteins of various H5N1 strains can be found in the GenBank-database, NCBI Influenza Virus Sequence Database, Influenza Sequence Database (ISD), EMBL-database and/or other databases. It is well within the reach of the skilled person to find such sequences in the respective databases. In another embodiment the HA antibodies of the invention are capable of specifically binding to a fragment of the above-mentioned proteins and/or polypeptides, wherein the fragment at least includes an antigenic determinant recognized by the HA antibodies of the invention. An "antigenic determinant" as used herein is a moiety that is capable of binding to an HA antibody of the invention with sufficiently high affinity to form a detectable antigen-antibody complex. As used herein, the terms "antigenic determinant" and "epitope" are equivalents. The HA antibodies of the invention may or may not be capable of specifically binding to the extracellular part of HA (also called herein soluble HA (sHA)).

The HA antibodies of the invention can be intact immunoglobulin molecules such as polyclonal or monoclonal antibodies or the HA antibodies can be antigen-binding fragments including, but not limited to, Fab, F(ab'), F(ab')2, Fv, dAb, Fd, complementarity determining region (CDR) fragments, single-chain antibodies (scFv), bivalent single-chain antibodies, single-chain phage antibodies, diabodies, triabodies, tetrabodies, and (poly)peptides that contain at least a fragment of an immunoglobulin that is sufficient to confer specific antigen binding to influenza virus H5N1 strains or a fragment thereof. In a preferred embodiment the HA antibodies are human monoclonal antibodies.

HA antibodies can be used in non-isolated or isolated form. Furthermore, the HA antibodies can be used alone or in a mixture including at least one HA antibody (or variant or fragment thereof). Thus, HA antibodies can be used in combination, e.g., as a pharmaceutical composition comprising two or more antibodies of the invention, variants or fragments thereof. For example, antibodies having different, but complementary activities can be combined in a single therapy to achieve a desired prophylactic, therapeutic or diagnostic effect, but alternatively, antibodies having identical activities can also be combined in a single therapy to achieve a desired prophylactic, therapeutic or diagnostic effect. Optionally, the mixture further includes at least one other therapeutic agent. Preferably, the therapeutic agent such as, e.g., M2 inhibitors (e.g., amantidine, rimantadine) and/or neuraminidase inhibitors (e.g., zanamivir, oseltamivir) is useful in the prophylaxis and/or treatment of an influenza virus H5N1 infection.

Typically, HA antibodies can bind to their binding partners, i.e. influenza virus H5N1 or fragments thereof, with an affinity constant (Kd-value) that is lower than $0.2 \times 10^{-4}$ M, $1.0 \times 10^{-5}$ M, $1.0 \times 10^{-6}$ M, $1.0 \times 10^{-7}$ M, preferably lower than $1.0 \times 10^{-8}$ M, more preferably lower than $1.0 \times 10^{-9}$ M, more preferably lower than $1.0 \times 10^{-10}$ M, even more preferably lower than $1.0 \times 10^{-11}$ M, and in particular lower than $1.0 \times 10^{-12}$ M. The affinity constants can vary for antibody isotypes. For example, affinity binding for an IgM isotype refers to a binding affinity of at least about $1.0 \times 10^{-7}$ M. Affinity constants can for instance be measured using surface plasmon resonance, for example using the BIACORE system (Pharmacia Biosensor AB, Uppsala, Sweden).

HA antibodies may bind to influenza virus H5N1 or a fragment thereof in soluble form such as for instance in a sample or in suspension or may bind to influenza virus H5N1 or a fragment thereof bound or attached to a carrier or substrate, e.g., microtiter plates, membranes and beads, etc. Carriers or substrates may be made of glass, plastic (e.g., polystyrene), polysaccharides, nylon, nitrocellulose, or Teflon, etc. The surface of such supports may be solid or porous and of any convenient shape. Furthermore, the HA antibodies may bind to influenza virus H5N1 in purified/isolated or non purified/non-isolated form.

HA antibodies exhibit neutralizing activity. Neutralizing activity can for instance be measured as described in International Patent Application PCT/EP2007/059356 (Publication No. WO 2008/028946, the contents of which are incorporated herein in their entirety). Alternative assays measuring neutralizing activity are described in for instance WHO Manual on Animal Influenza Diagnosis and Surveillance, Geneva: World Health Organization, 2005, version 2002.5.

The invention relates to an isolated human HA antibody that recognizes and binds to an epitope in the HA2 subunit of the influenza haemagglutinin protein (HA), characterized in that said HA antibody has neutralizing activity against an influenza virus, for instance, including HA of the H5 subtype. Examples of influenza strains that contain such a HA of the H5 subtype and that are important strains in view of pandemic threats are H5N1, H5N2, H5N8, and H5N9. Particularly preferred are HA antibodies that at least neutralize the H5N1 influenza strain. Preferably, HA antibodies do not depend on an epitope in the HA1 subunit of the HA protein for binding to said HA protein.

Definitions

The term "human HA antibody" describes an intact immunoglobulin including monoclonal antibodies, such as chimeric, humanized or human monoclonal antibodies, or to an antigen-binding and/or variable domain comprising fragment of an immunoglobulin that competes with the intact immunoglobulin for specific binding to the binding partner of the immunoglobulin, e.g. H5N1. Regardless of structure, the antigen binding fragment binds with the same antigen that is recognized by the intact immunoglobulin. An antigen-binding fragment can comprise a peptide or polypeptide comprising an amino acid sequence of at least 2, 5, 10, 15, 20, 25, 30, 35, 40, 50, 60, 70, 80, 90, 100, 125, 150, 175, 200, or 250 contiguous amino acid residues of the amino acid sequence of the HA antibody.

The term "HA antibody", includes all immunoglobulin classes and subclasses known in the art. Depending on the amino acid sequence of the constant domain of their heavy chains, HA antibodies can be divided into the five major classes of intact antibodies: IgA, IgD, IgE, IgG, and IgM, and several of these may be further divided into subclasses (isotypes), e.g., IgA1, IgA2, IgG1, IgG2, IgG3 and IgG4.

Antigen-binding fragments include, inter alia, Fab, F(ab'), F(ab')2, Fv, dAb, Fd, complementarity determining region (CDR) fragments, single-chain antibodies (scFv), bivalent single-chain antibodies, single-chain phage antibodies, diabodies, triabodies, tetrabodies, (poly)peptides that contain at least a fragment of an immunoglobulin that is sufficient to confer specific antigen binding to the (poly)peptide, etc. The above fragments may be produced synthetically or by enzymatic or chemical cleavage of intact immunoglobulins or they may be genetically engineered by recombinant DNA techniques. The methods of production are well known in the art and are described, for example, in Antibodies: A Laboratory Manual, Edited by: E. Harlow and D, Lane (1988), Cold Spring Harbor Laboratory, Cold Spring Harbor, N.Y., which is incorporated herein by reference. An HA antibody or antigen-binding fragment thereof may have one or more binding sites. If there is more than one binding site, the binding sites may be identical to one another or they may be different.

With respect to HA antibodies, the term "complementarity determining regions" (CDR) as used herein means sequences within the variable regions of HA antibodies, such as immunoglobulins, that usually contribute to a large extent to the antigen binding site which is complementary in shape and charge distribution to the epitope recognized on the antigen. The CDR regions of HA antibodies can be specific for linear epitopes, discontinuous epitopes, or conformational epitopes of proteins or protein fragments, either as present on the protein in its native conformation or, in some cases, as present on the proteins as denatured, e.g., by solubilization in SDS. Epitopes of HA antibodies may also consist of posttranslational modifications of proteins.

The term "functional variant", as used herein, refers to an HA antibody that includes a nucleotide and/or amino acid sequence that is altered by one or more nucleotides and/or amino acids compared to the nucleotide and/or amino acid sequences of the parental HA antibody and that is still capable of competing for binding to the binding partner, e.g. H5N1, with the parental HA antibody. In other words, the modifications in the amino acid and/or nucleotide sequence of the parental HA antibody do not significantly affect or alter the binding characteristics of the HA antibody encoded by the nucleotide sequence or containing the amino acid sequence, i.e. the antibody is still able to recognize and bind its target. The functional variant may have conservative sequence modifications including nucledtide and amino acid substitutions, additions and deletions. These modifications can be introduced by standard techniques known in the art, such as site-directed mutagenesis and random PCR-mediated mutagenesis, and may include natural as well as non-natural nucleotides and amino acids.

Conservative amino acid substitutions include the ones in which the amino acid residue is replaced with an amino acid residue having similar structural or chemical properties. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., asparagine, glutamine, serine, threonine, tyrosine, cysteine, tryptophan), non-polar side chains (e.g., glycine, alanine, valine, leucine, isoleucine, proline, phenylalanine, methionine), beta-branched side chains (e.g., threonine, valine, isoleucine) and aromatic side chains (e.g., tyrosine, phenylalanine, tryptophan). It will be clear to the skilled artisan that other classifications of amino acid residue families than the one used above can also be employed. Furthermore, a HA antibody functional variant may have non-conservative amino acid substitutions, e.g., replacement of an amino acid with an amino acid residue having different structural or chemical properties. Similar minor variations may also include amino acid deletions or insertions, or both. Guidance in determining which amino acid residues may be substituted, inserted, or deleted without abolishing immunological activity may be found using computer programs well known in the art.

A mutation in a nucleotide sequence can be a single alteration made at a locus (a point mutation), such as transition or transversion mutations, or alternatively, multiple nucleotides may be inserted, deleted or changed at a single locus. In addition, one or more alterations may be made at any number of loci within a nucleotide sequence. The mutations may be performed by any suitable method known in the art.

The term "human", when applied to HA antibodies, refers to molecules that are either directly derived from a human or based upon a human sequence. When an HA antibody is derived from or based on a human sequence and subsequently modified, it is still to be considered human as used throughout the specification. In other words, the term human, when applied to HA antibodies is intended to include antibodies having variable and constant regions derived from human germline immunoglobulin sequences or based on variable or constant regions occurring in a human or human lymphocyte and modified in some form. Thus, the human HA antibodies may include amino acid residues not encoded by human germline immunoglobulin sequences, contain substitutions and/or deletions (e.g., mutations introduced by for instance random or site-specific mutagenesis in vitro or by somatic mutation in vivo). "Based on" as used herein refers to the situation that a nucleic acid sequence may be exactly copied from a template, or with minor mutations, such as by error-prone PCR methods, or synthetically made matching the template exactly or with minor modifications. Semi-synthetic molecules based on human sequences are also considered to be human as used herein.

Single Chain HA Antibodies

The heavy chain of an HA antibody is derived from a germ line V (variable) gene such as, for example, the VH1 or VH3 germline gene (see, Tomlinson I M, Williams S C, Ignatovitch O, Corbett S J, Winter G. V-BASE Sequence Directory. Cambridge, United Kingdom: MRC Centre for Protein Engineering (1997)). The HA antibodies of the invention include a $V_H$ region that is encoded by a nucleic acid sequence that is at least 80% homologous to the VH1 or VH3 germline gene sequence. Preferably, the nucleic acid sequence is at least 90%, 95%, 96%, 97% homologous to the VH1 or VH3 germline gene sequence, and more preferably, at least 98%, 99% homologous to the VH1 or VH3 germline gene sequence. The $V_H$ region of the HA antibody is at least 80% homologous to the amino acid sequence of the $V_H$ region encoded by the VH1 or VH3 $V_H$ germline gene sequence. Preferably, the amino acid sequence of $V_H$ region of the HA antibody is at least 90%, 95%, 96%, 97% homologous to the amino acid sequence encoded by the VH1 or VH3 germline gene sequence, and more preferably, at least 98%, 99% homologous to the sequence encoded by the VH1 or VH3 germline gene sequence.

In certain aspects of the invention the VH1 germline gene is VH1 (1-2), VH1 (1-18), VH1 (3-23), or VH1 (1-69). In other aspects of the invention the VH3 germline gene is VH3 (3-21)

The HA antibodies of the invention also include a variable light chain ($V_L$) region encoded by a human germline gene sequence selected from the group consisting of VKI, VKII, VKIII, VKIV, VL1, VL2, and VL3 (see, Tomlinson I M, Williams S C, Ignatovitch O, Corbett S J, Winter G. V-BASE Sequence Directory. Cambridge, United Kingdom: MRC Centre for Protein Engineering (1997)). Alternatively, the HA antibodies include a $V_L$ region that is encoded by a nucleic acid sequence that is at least 80% homologous to the germline gene sequence of VKI, VKII, VKIII, VKIV, VL1, VL2, or VL3. Preferably, the nucleic acid sequence is at least 90%, 95%, 96%, 97% homologous to the germline gene sequence of VKI, VKII, VKIII, VKIV, VL1, VL2, or VL3, and more preferably, at least 98%, 99% homologous to the germline gene sequence of VKI, VKII, VKIII, VKIV, VL1, VL2, or VL3. The $V_L$ region of the HA antibody is at least 80% homologous to the amino acid sequence of the $V_L$ region encoded the germline gene sequence of VKI, VKII, VKIII, VKIV, VL1, VL2, or VL3. Preferably, the amino acid sequence of $V_L$ region of the HA antibody is at least 90%, 95%, 96%, 97% homologous to the amino acid sequence encoded by the germline gene sequence of VKI, VKII, VKIII, VKIV, VL1, VL2, or VL3, and more preferably, at least 98%, 99% homologous to the sequence encoded by the germline gene sequence of VKI, VKII, VKIII, VKIV, VL1, VL2, or VL3.

In certain aspects of the invention the VKI germline gene is VKI (A20), the VKII germline gene is VKII (A3), the VKIII germline gene is VKIII (A27), and the VKIV germline gene is VKIV (B3). In other aspects of the invention, the VL1 germline gene is VL1 (V1-13), VL1 (V1-16), VL1 (V1-17), or. VL1 (V1-19). Alternatively, the VL2 germline gene is VL2 (V1-3) or VL2 (V1-4). Furthermore, the VL3 germline gene is VL3 (V2-14).

Specific combinations of a VH- and HL-locus are provided for each HA antibody described below.

The CDR regions of the HA antibodies of the invention were determined according to Kabat et al. (1991) as described in Sequences of Proteins of Immunological Interest. In certain embodiments of the invention, HA antibodies contain two, three, four, five or all six CDR regions as disclosed herein. Preferably, HA antibodies contain at least two of the CDRs disclosed herein.

The SC06-141 HA-specific single-chain Fv antibody includes a heavy chain variable region (SEQ ID NO: 309) and a light chain variable region (SEQ ID NO: 310) encoded by the nucleic acid sequence shown in SEQ ID NO: 311 and the amino acid sequence shown in SEQ ID NO: 312. The VH-locus is VH1 (1-18) and the VL locus is HKIV (B3).

The amino acids encompassing the CDRs are highlighted in bold in the sequences below. The heavy chain CDRs of the SC06-141 antibody have the following CDR sequences: GYYVY (HCDR1, SEQ ID NO: 247), WISAYNGNT-NYAQKFQG (HCDR2, SEQ ID NO: 248) and SRSLDV (HCDR3, SEQ ID NO: 568). The light chain CDRs of the SC06-141 antibody have the following CDR sequences: KSSQSVLYSSNNKNYLA (LCDR1, SEQ ID NO: 569), WASTRES (LCDR2, SEQ ID NO: 570) and QQYYSTPLT (LCDR3, SEQ ID NO: 289).

```
SC06-141 nucleotide sequence
                                        (SEQ ID NO: 311)
gaggtccagc tggtgcagtc tggggctgag gtgaagaagc        60
ctggggcctc agtgaaggtc tcctgcaagg cttctgggta caccttcacc ggctactatg       120
tgtactgggt gcgacaggcc cctggacaag ggcttgagtg gatgggatgg atcagcgctt       180
acaatggtaa cacaaactat gcacagaagt tccagggcag agtcacgatt accgcggaca       240
aatccacgag cacagcctac atggagctga gcagcctgag atctgaagac acggctgtgt       300
attactgtgc gagaagtaga tccctggacg tctggggcca agggaccacg gtcaccgtct       360
cgagcggtac gggcggttca ggcggaaccg gcagcggcac tggcgggtcg acggatgttg       420
tgatgactca gtctccagac tccctggctg tgtctctggg cgagagggcc accatcaact       480
gcaagtccag ccagagtgtt ttatacagct ccaacaataa gaactactta gcttggtacc       540
agcagaaacc aggacagcct cctaagctgc tcatttactg ggcatctacc cgggaatccg       600
gggtccctga ccgattcagt ggcagcgggt ctgggacaga tttcactctc accatcagca       660
gcctgcaggc tgaagatgtg gcagtttatt actgtcagca atattatagt actcctctca       720
ctttcggcgg agggaccaaa gtggatatca aacgt                                  735

SC06-141 amino acid sequence
                                        (SEQ ID NO: 312)
EVQLVQSGAEVKKPGASVKVSCKASGYTFTGYYVYWVRQAPGQGLEWMG

WISAYNGNTNYAQKFQGRVTITADKSTSTAYMELSSLRSEDTAVYYCAR

SRSLDVWGQGTTVTVSSGTGGSGGTGSGTGGSTDVVMTQSPDSLAVSLG
```

```
ERATINCKSSQSVLYSSNNKNYLAWYQQKPGQPPKLLIYWASTRESGVP

DRFSGSGSGTDFTLTISSLQAEDVAVYYCQQYYSTPLTFGGGTKVDIKR

SC06-141 VH amino acid sequence
                                        (SEQ ID NO: 309)
EVQLVQSGAEVKKPGASVKVSCKASGYTFTGYYVYWVRQAPGQGLEWMG

WISAYNGNTNYAQKFQGRVTITADKSTSTAYMELSSLRSEDTAVYYCAR

SRSLDVWGQGTTVTVSS

SC06-141 VL amino acid sequence
                                        (SEQ ID NO: 310)
DVVMTQSPDSLAVSLGERATINCKSSQSVLYSSNNKNYLAWYQQKPGQP

PKLLIYWASTRESGVPDRFSGSGSGTDFTLTISSLQAEDVAVYYCQQYY

STPLTFGGGTKVDIKR
```

The SC06-255 HA-specific single-chain Fv antibody includes a heavy chain variable region (SEQ ID NO: 313) and a light chain variable region (SEQ ID NO: 314) encoded by the nucleic acid sequence shown in SEQ ID NO: 315 and the amino acid sequence shown in SEQ ID NO: 316. The VH-locus is VH1 (1-69) and the VL locus is VL1 (V1-16).

The amino acids encompassing the CDRs are highlighted in bold in the sequences below. The heavy chain CDRs of the SC06-255 antibody have the following CDR sequences: SYAIS (HCDR1, SEQ ID NO: 571), GIIPIFGTTKYAPK-FQG (HCDR2, SEQ ID NO: 572) and HMGYQVRETMDV (HCDR3, SEQ ID NO: 573). The light chain CDRs of the SC06-255 antibody have the following CDR sequences: SGSTFNIGSNAVD (LCDR1, SEQ ID NO: 574), SNNQRPS (LCDR2, SEQ ID NO: 575) and AAWDDILNVPV (LCDR3, SEQ ID NO: 576).

```
SC06-255 nucleotide sequence
                                        (SEQ ID NO: 315)
gaggtgcagc tggtggagtc tggggctgag gtgaagaagc        60
ctgggtcctc ggtgaaagtc tcttgcaagg cttctggagg ccccttccgc agctatgcta       120
tcagctgggt gcgacaggcc cctggacaag ggcctgagtg gatgggaggg atcatcccta       180
tttttggtac aacaaaatac gcaccgaagt tccagggcag agtcacgatt accgcggacg       240
atttcgcggg cacagtttac atggagctga gcagcctgcg atctgaggac acggccatgt       300
actactgtgc gaaacatatg gggtaccagg tgcgcgaaac tatggacgtc tggggcaaag       360
ggaccacggt caccgtctcg agcggtacgg gcggttcagg cggaaccggc agcggcactg       420
gcgggtcgac gtcctatgtg ctgactcagc cacccctcagc gtctgggacc cccgggcaga       480
gggtcaccat ctcttgttct ggaagcacgt tcaacatcgg aagtaatgct gtagactggt       540
accggcagct cccaggaacg gccccaaac tcctcatcta tagtaataat cagcggccct        600
caggggtccc tgaccgattc tctggctcca ggtctggcac ctcagcctcc ctggccatca       660
gtgggctcca gtctgaggat gaggctgatt attactgtgc agcatgggat gacatcctga       720
atgttccggt attcggcgga
```

-continued

```
gggaccaagc tgaccgtcct aggt                        744
```

SC06-255 amino acid sequence
(SEQ ID NO: 316)
EVQLVESGAEVKKPGSSVKVSCKASGGPFRSYAISWVRQAPGQGPEWMG

GIIPIFGTTKYAPKFQGRVTITADDFAGTVYMELSSLRSEDTAMYYCAK

HMGYQVRETMDVWGKGTTVTVSSGTGGSGGTGSGTGGSTSYVLTQPPSA

SGTPGQRVTISCSGSTFNIGSNAVDWYRQLPGTAPKLLIYSNNQRPSGV

PDRFSGSRSGTSASLAISGLQSEDEADYYCAAWDDILNVPVFGGGTKLT

VLG

SC06-255 VH amino acid sequence
(SEQ ID NO: 313)
EVQLVESGAEVKKPGSSVKVSCKASGGPFRSYAISWVRQAPGQGPEWMG

GIIPIFGTTKYAPKFQGRVTITADDFAGTVYMELSSLRSEDTAMYYCAK

HMGYQVRETMDVWGKGTTVTVSS

SC06-255 VL amino acid sequence
(SEQ ID NO: 314)
SYVLTQPPSASGTPGQRVTISCSGSTFNIGSNAVDWYRQLPGTAPKLLI

YSNNQRPSGVPDRFSGSRSGTSASLAISGLQSEDEADYYCAAWDDILNV

PVFGGGTKLTVLG

The SC06-257 HA-specific single-chain Fv antibody includes a heavy chain variable region (SEQ ID NO: 317) and a light chain variable region (SEQ ID NO: 318) encoded by the nucleic acid sequence shown in SEQ ID NO: 319 and the amino acid sequence shown in SEQ ID NO: 320. The VH-locus is VH1 (1-69) and the VL locus is VL2 (V1-4).

The amino acids encompassing the CDRs are highlighted in bold in the sequences below. The heavy chain CDRs of the SC06-257 antibody have the following CDR sequences: SYAIS (HCDR1, SEQ ID NO: 571), GIIPIFGTTKYAPKFQG (HCDR2, SEQ ID NO: 572) and HMGYQVRETMDV (HCDR3, SEQ ID NO: 573). The light chain CDRs of the SC06-257 antibody have the following CDR sequences: TGTSSDVGGYNYVS (LCDR1, SEQ ID NO: 577), EVSNRPS (LCDR2, SEQ ID NO: 578) and SSYTSSSTY (LCDR3, SEQ ID NO: 579).

```
SC06-257 nucleotide sequence
                                  (SEQ ID NO: 319)
caggtccagc tggtgcagtc tggggctgag gtgaagaagc        60
ctgggtcctc ggtgaaagtc tcttgcaagg cttctggagg ccccttccgc agctatgcta       120
tcagctgggt gcgacaggcc cctggacaag ggcctgagtg gatgggaggg atcatcccta       180
tttttggtac aacaaaatac gcaccgaagt tccaggcag  agtcacgatt accgcggacg       240
atttcgcggg cacagtttac atggagctga gcagcctgcg atctgaggac acggccatgt       300
actactgtgc gaaacatatg gggtaccagg tgcgcgaaac tatggacgtc tggggcaaag       360
ggaccacggt caccgtctcg agcggtacgg gcggttcagg cggaaccggc agcggcactg       420
gcgggtcgac gcagtctgcc ctgactcagc ctgccgccgt gtctgggtct cctggacagt       480
cgatcaccat ctcctgcact
```

```
ggaaccagca gtgacgttgg tggttataac tatgtctcct       540
ggtaccaaca gcacccaggc aaagccccca aactcatgat ttatgaggtc agtaatcggc       600
cctcaggggt ttctaatcgc ttctctggct ccaagtctgg caacacggcc tccctgacca       660
tctctgggct ccaggctgag gacgaggctg attattactg cagctcatat acaagcagca       720
gcacttatgt cttcggaact gggaccaagg tcaccgtcct aggt                        744
```

SC06-257 amino acid sequence
(SEQ ID NO: 320)
QVQLVQSGAEVKKPGSSVKVSCKASGGPFRSYAISWVRQAPGQGPEWMG

GIIPIFGTTKYAPKFQGRVTITADDFAGTVYMELSSLRSEDTAMYYCAK

HMGYQVRETMDVWGKGTTVTVSSGTGGSGGTGSGTGGSTQSALTQPAAV

SGSPGQSITISCTGTSSDVGGYNYVSWYQQHPGKAPKLMIYEVSNRPSG

VSNRFSGSKSGNTASLTISGLQAEDEADYYCSSYTSSSTYVFGTGTKVT

VLG

SC06-257 VH amino acid sequence
(SEQ ID NO: 317)
QVQLVQSGAEVKKPGSSVKVSCKASGGPFRSYAISWVRQAPGQGPEWMG

GIIPIFGTTKYAPKFQGRVTITADDFAGTVYMELSSLRSEDTAMYYCAK

HMGYQVRETMDVWGKGTTVTVSS

SC06-257 VL amino acid sequence
(SEQ ID NO: 318)
QSALTQPAAVSGSPGQSITISCTGTSSDVGGYNYVSWYQQHPGKAPKLM

IYEVSNRPSGVSNRFSGSKSGNTASLTISGLQAEDEADYYCSSYTSSST

YVFGTGTKVTVLG

The SC06-260 HA-specific single-chain Fv antibody includes a heavy chain variable region (SEQ ID NO: 321) and a light chain variable region (SEQ ID NO: 322) encoded by the nucleic acid sequence shown in SEQ ID NO: 323 and the amino acid sequence shown in SEQ ID NO: 324. The VH-locus is VH1 (1-69) and the VL locus is VL1 (V1-17).

The amino acids encompassing the CDRs are highlighted in bold in the sequences below. The heavy chain CDRs of the SC06-260 antibody have the following CDR sequences: SYAIS (HCDR1, SEQ ID NO: 571), GIIPIFGTTKYAPKFQG (HCDR2, SEQ ID NO: 572) and HMGYQVRETMDV (HCDR3, SEQ ID NO: 573). The light chain CDRs of the SC06-260 antibody have the following CDR sequences: SGSRSNVGDNSVY (LCDR1, SEQ ID NO: 580), KNTQRPS (LCDR2, SEQ ID NO: 581) and VAWDDSVDGYV (LCDR3, SEQ ID NO: 582).

```
SC06-260 nucleotide sequence
                                  (SEQ ID NO: 323)
gaggtgcagc tggtggagtc tggggctgag gtgaagaagc        60
ctgggtcctc ggtgaaagtc tcttgcaagg cttctggagg ccccttccgc agctatgcta       120
tcagctgggt gcgacaggcc cctggacaag ggcctgagtg gatgggaggg atcatcccta       180
tttttggtac aacaaaatac gcaccgaagt tccaggcag  agtcacgatt accgcggacg       240
atttcgcggg cacagtttac
```

-continued
```
atggagctga gcagcctgcg atctgaggac acggccatgt    300
actactgtgc gaaacatatg gggtaccagg tgcgcgaaac tatggacgtc tggggcaaag    360
ggaccacggt caccgtctcg agcggtacgg gcggttcagg cggaaccggc agcggcactg    420
gcgggtcgac gtcctatgtg ctgactcagc caccctcagt ctctgggacc cccgggcaga    480
gggtcaccat ctcttgctct ggaagccgct ccaacgtcgg agataattct gtatattggt    540
atcaacacgt cccagaaatg gccccaaaac tcctcgtcta taagaatact caacggccct    600
caggagtccc tgcccggttt tccggctcca agtctggcac ttcagcctcc ctggccatca    660
ttggcctcca gtccggcgat gaggctgatt attattgtgt ggcatgggat gacagcgtag    720
atggctatgt cttcggatct gggaccaagg tcaccgtcct aggt    744
```

SC06-260 amino acid sequence
(SEQ ID NO: 324)
EVQLVESGAEVKKPGSSVKVSCKASGGPFRSYAISWVRQAPGQGPEWMG

GIIPIFGTTKYAPKFQGRVTITADDFAGTVYMELSSLRSEDTAMYYCAK

HMGYQVRETMDVWGKGTTVTVSSGTGGSGGTGSGTGGSTSYVLTQPPSV

SGTPGQRVTISCSGSRSNVGDNSVYWYQHVPEMAPKLLVYKNTQRPSGV

PARFSGSKSGTSASLAIIGLQSGDEADYYCVAWDDSVDGYVFGSGTKVT

VLG

SC06-260 VH amino acid sequence
(SEQ ID NO: 321)
EVQLVESGAEVKKPGSSVKVSCKASGGPFRSYAISWVRQAPGQGPEWMG

GIIPIFGTTKYAPKFQGRVTITADDFAGTVYMELSSLRSEDTAMYYCAK

HMGYQVRETMDVWGKGTTVTVSS

SC06-260 VL amino acid sequence
(SEQ ID NO: 322)
SYVLTQPPSVSGTPGQRVTISCSGSRSNVGDNSVYWYQHVPEMAPKLLV

YKNTQRPSGVPARFSGSKSGTSASLAIIGLQSGDEADYYCVAWDDSVDG

YVFGSGTKVTVLG

The SC06-261 HA-specific single-chain Fv antibody includes a heavy chain variable region (SEQ ID NO: 325) and a light chain variable region (SEQ ID NO: 326) encoded by the nucleic acid sequence shown in SEQ ID NO: 327 and the amino acid sequence shown in SEQ ID NO: 328. The VH-locus is VH1 (1-69) and the VL locus is VL1 (V1-19).

The amino acids encompassing the CDRs are highlighted in bold in the sequences below. The heavy chain CDRs of the SC06-261 antibody have the following CDR sequences: SYAIS (HCDR1, SEQ ID NO: 571), GIIPIFGTTKYAPKFQG (HCDR2, SEQ ID NO: 572) and HMGYQVRETMDV (HCDR3, SEQ ID NO: 573). The light chain CDRs of the SC06-261 antibody have the following CDR sequences: SGSSSNIGNDYVS (LCDR1, SEQ ID NO: 583), DNN-KRPS (LCDR2, SEQ ID NO: 584) and ATWDRRPTAYVV (LCDR3, SEQ ID NO: 585).

SC06-261 nucleotide sequence
(SEQ ID NO: 327).
```
gaggtgcagc tggtggagtc tggggctgag gtgaagaagc     60
ctgggtcctc ggtgaaagtc tcttgcaagg cttctggagg ccccttccgc agctatgcta    120
tcagctgggt gcgacaggcc cctggacaag ggcctgagtg gatgggaggg atcatcccta    180
tttttggtac aacaaaatac gcaccgaagt tccagggcag agtcacgatt accgcggacg    240
atttcgcggg cacagtttac atggagctga gcagcctgcg atctgaggac acggccatgt    300
actactgtgc gaaacatatg gggtaccagg tgcgcgaaac tatggacgtc tggggcaaag    360
ggaccacggt caccgtctcg agcggtacgg gcggttcagg cggaaccggc agcggcactg    420
gcgggtcgac gcagtctgtg ttgacgcagc cgccctcagt gtctgcggcc ccaggacaga    480
aggtcaccat ctcctgctct ggaagcagct ccaacattgg gaatgattat gtatcctggt    540
accagcagct cccaggaaca gcccccaaac tcctcattta tgacaataat aagcgaccct    600
cagggattcc tgaccgattc tctggctcca agtctggcac gtcagccacc ctgggcatca    660
ccggactcca gactgggac gaggccaact attactgcgc aacatgggat gccgcccga    720
ctgcttatgt tgtcttcggc ggagggacca agctgaccgt cctaggt    747
```

SC06-261 amino acid sequence
(SEQ ID NO: 328)
EVQLVESGAEVKKPGSSVKVSCKASGGPFRSYAISWVRQAPGQGPEWMG

GIIPIFGTTKYAPKFQGRVTITADDFAGTVYMELSSLRSEDTAMYYCAK

HMGYQVRETMDVWGKGTTVTVSSGTGGSGGTGSGTGGSTQSVLTQPPSV

SAAPGQKVTISCSGSSSNIGNDYVSWYQQLPGTAPKLLIYDNNKRPSGI

PDRFSGSKSGTSATLGITGLQTGDEANYYCATWDRRPTAYVVFGGGTKL

TVLG

SC06-261 VH amino acid sequence
(SEQ ID NO: 325)
EVQLVESGAEVKKPGSSVKVSCKASGGPFRSYAISWVRQAPGQGPEWMG

GIIPIFGTTKYAPKFQGRVTITADDFAGTVYMELSSLRSEDTAMYYCAK

HMGYQVRETMDVWGKGTTVTVSS

SC06-261 VL amino acid sequence
(SEQ ID NO: 326)
SVLTQPPSVSAAPGQKVTISCSGSSSNIGNDYVSWYQQLPGTAPKLLIY

DNNKRPSGIPDRFSGSKSGTSATLGITGLQTGDEANYYCATWDRRPTAY

VVFGGGTKLTVLG

The SC06-262 HA-specific single-chain Fv antibody includes a heavy chain variable region (SEQ ID NO: 329) and a light chain variable region (SEQ ID NO: 330) encoded by the nucleic acid sequence shown in SEQ ID NO: 331 and the amino acid sequence shown in SEQ ID NO: 332. The VH-locus is VH1 (1-69) and the VL locus is VKI (A20).

The amino acids encompassing the CDRs are highlighted in bold in the sequences below. The heavy chain CDRs of the SC06-262 antibody have the following CDR sequences: GSAIS (HCDR1, SEQ ID NO: 586), GISPLFGTTNYAQKFQG (HCDR2, SEQ ID NO: 587) and GPKYYSEYMDV (HCDR3, SEQ ID NO: 588). The light chain CDRs of the SC06-262 antibody have the following CDR sequences: RASQGISSYLA (LCDR1, SEQ ID NO: 589), DASTLRS (LCDR2, SEQ ID NO: 590) and QRYNSAPPI (LCDR3, SEQ ID NO: 591).

```
SC06-262 nucleotide sequence
                                       (SEQ ID NO: 331)
caggtacagc tgcagcagtc aggggctgag gtgaagaagc      60
ctgggtcctc ggtgaaggtc tcctgcaagg tttccggagt cattttcagc ggcagtgcga     120
tcagctgggt gcgacaggcc cctggacaag gccttgagtg gatgggaggg atcagccctc     180
tctttggcac aacaaattac gcacaaaagt tccagggcag agtcacgatt accgcggacc     240
aatccacgaa cacaacctac atggaggtga acagcctgag atatgaggac acggccgtgt     300
atttctgtgc gcgaggtcca aaatattaca gtgagtacat ggacgtctgg ggcaaaggga     360
ccacggtcac cgtctcgagc ggtacgggcg gttcaggcgg aaccggcagc ggcactggcg     420
ggtcgacgga catccagatg acccagtctc catcctccct gtctgcatct gtaggagaca     480
gagtcaccat cacttgccgg gcgagtcagg gcattagcag ttatttagcc tggtatcagc     540
agaagccagg gaaagttcct acactcctga tctatgatgc atccactttg cgatcagggg     600
tcccatctcg cttcagtggc agtggatctg cgacagattt cactctcacc atcagcagcc     660
tgcagcctga agatgttgca acttattact gtcaaaggta taacagtgcc ccccgatca      720
ccttcggcca agggacacga ctggagatta aacgt                                735

SC06-262 amino acid sequence
                                       (SEQ ID NO: 332)
QVQLQQSGAEVKKPGSSVKVSCKVSGVIFSGSAISWVRQAPGQGLEWMG

GISPLFGTTNYAQKFQGRVTITADQSTNTTYMEVNSLRYEDTAVYFCAR

GPKYYSEYMDVWGKGTTVTVSSGTGGSGGTGSGTGGSTDIQMTQSPSSL

SASVGDRVTITCRASQGISSYLAWYQQKPGKVPTLLIYDASTLRSGVPS

RFSGSGSATDFTLTISSLQPEDVATYYCQRYNSAPPITFGQGTRLEIKR

SC06-262 VH amino acid sequence
                                       (SEQ ID NO: 329)
QVQLQQSGAEVKKPGSSVKVSCKVSGVIFSGSAISWVRQAPGQGLEWMG

GISPLFGTTNYAQKFQGRVTITADQSTNTTYMEVNSLRYEDTAVYFCAR

GPKYYSEYMDVWGKGTTVTVSS

SC06-262 VL amino acid sequence
                                       (SEQ ID NO: 330)
DIQMTQSPSSLSASVGDRVTITCRASQGISSYLAWYQQKPGKVPTLLIY

DASTLRSGVPSRFSGSGSATDFTLTISSLQPEDVATYYCQRYNSAPPIT

FGQGTRLEIKR
```

The SC06-268 HA-specific single-chain Fv antibody includes a heavy chain variable region (SEQ ID NO: 333) and a light chain variable region (SEQ ID NO: 334) encoded by the nucleic acid sequence shown in SEQ ID NO: 335 and the amino acid sequence shown in SEQ ID NO: 336. The VH-locus is VH1 (1-69) and the VL locus is VL3 (V2-14).

The amino acids encompassing the CDRs are highlighted in bold in the sequences below. The heavy chain CDRs of the SC06-268 antibody have the following CDR sequences: SYAIS (HCDR1, SEQ ID NO: 571), GIMGMFGTTNYAQKFQG (HCDR2, SEQ ID NO: 592) and SSGYYPEYFQD (HCDR3, SEQ ID NO: 593). The light chain CDRs of the SC06-268 antibody have the following CDR sequences: SGHKLGDKYVS (LCDR1, SEQ ID NO: 594), QDNRRPS (LCDR2, SEQ ID NO: 595) and QAWDSSTA (LCDR3, SEQ ID NO: 596).

```
SC06-268 nucleotide sequence
                                       (SEQ ID NO: 335)
caggtccagc tggtacagtc tggggctgag gtgaagaagc      60
ctgggtcctc ggtgaaggtc tcctgcaagg cttctggagg caccttcagt agttatgcta    120
tcagctgggt gcgacaggcc cctggacaag gcttgagtg gatgggagga atcatgggta     180
tgtttggcac aactaactac gcacagaagt tccagggcag agtcacgatt accgcggacg    240
aattcacgag cgcagcctac atggagctga ggagcctgag atctgaggac acggccgtct    300
actactgtgc gaggtctagt ggttattacc ccgaatactt ccaggactgg ggcagggca     360
ccctggtcac cgtctcgagc ggtacgggcg gttcaggcgg aaccggcagc ggcactggcg    420
ggtcgacgca gtctgtgctg actcagccac cctcagagtc cgtgtcccca ggacagacag    480
ccagcgtcac ctgctctgga cataaattgg gggataaata tgtttcgtgg tatcagcaga    540
agccaggcca gtcccctgta ttactcatct atcaagataa caggcggccc tcagggatcc    600
ctgagcgatt cataggctcc aactctggga acacagccac tctgaccatc agcgggaccc    660
aggctctgga tgaggctgac tattactgtc aggcgtggga cagcagcact gcggtttttcg    720
gcggagggac caagctgacc gtcctaggt                                        729

SC06-268 amino acid sequence
                                       (SEQ ID NO: 336)
QVQLVQSGAEVKKPGSSVKVSCKASGGTFSSYAISWVRQAPGQGLEWMG

GIMGMFGTTNYAQKFQGRVTITADEFTSAAYMELRSLRSEDTAVYYCAR

SSGYYPEYFQDWGQGTLVTVSSGTGGSGGTGSGTGGSTQSVLTQPPSES

VSPGQTASVTCSGHKLGDKYVSWYQQKPGQSPVLLIYQDNRRPSGIPER

FIGSNSGNTATLTISGTQALDEADYYCQAWDSSTAVFGGGTKLTVLG

SC06-268 VH amino acid sequence
                                       (SEQ ID NO: 333)
QVQLVQSGAEVKKPGSSVKVSCKASGGTFSSYAISWVRQAPGQGLEWMG

GIMGMFGTTNYAQKFQGRVTITADEFTSAAYMELRSLRSEDTAVYYCAR
```

SSGYYPEYFQDWGQGTLVTVSS

SC06-268 VL amino acid sequence
(SEQ ID NO: 334)
QSVLTQPPSESVSPGQTASVTCSGHKLGDKYVSWYQQKPGQSPVLLIYQ

DNRRPSGIPERFIGSNSGNTATLTISGTQALDEADYYCQAWDSSTAVFG

GGTKLTVLG

The SC06-272 HA-specific single-chain Fv antibody includes a heavy chain variable region (SEQ ID NO: 337) and a light chain variable region (SEQ ID NO: 338) encoded by the nucleic acid sequence shown in SEQ ID NO: 339 and the amino acid sequence shown in SEQ ID NO: 340. The VH-locus is VH1 (1-69) and the VL locus is VL2 (V1-3).

The amino acids encompassing the CDRs are highlighted in bold in the sequences below. The heavy chain CDRs of the SC06-272 antibody have the following CDR sequences: SYAIT (HCDR1, SEQ ID NO: 597), GIIGMFGSTNYAQN-FQG (HCDR2, SEQ ID NO: 598) and STGYYPAYLHH (HCDR3, SEQ ID NO: 599). The light chain CDRs of the SC06-272 antibody have the following CDR sequences: TGTSSDVGGYNYVS (LCDR1, SEQ ID NO: 577), DVSKRPS (LCDR2, SEQ ID NO: 601) and SSYTSSSTHV (LCDR3, SEQ ID NO: 602).

```
SC06-272 nucleotide sequence
                             (SEQ ID NO: 339)
cagatgcagc tggtgcagtc tggggctgag gtgaagaagc      60
ctgggtcctc ggtgaaggtc tcctgcaagg cttctggagg caccttctcc agttatgcta     120
tcacctgggt gcgacaggcc cctggacaag ggcttgagtg gatgggaggg atcatcggta     180
tgtttggttc aacaaactac gcacagaact ccagggcag agtcacgatt accgcggacg     240
aatccacgag cacagcctac atggagctga gcagcctcag atctgaggac acggccgtgt     300
attactgtgc gagaagtact ggttattacc ctgcatacct ccaccactgg ggccagggca     360
ccctggtcac cgtctcgagc ggtacgggcg gttcaggcgg aaccggcagc ggcactggcg     420
ggtcgacgca gtctgccctg actcagcctc gctcagtgtc cgggtctcct ggacagtcag     480
tcaccatctc ctgcactgga accagcagtg atgttggtgg ttataactat gtctcctggt     540
accaacagca cccaggcaaa gcccccaaac tcatgattta tgatgtcagt aagcggccct     600
caggggtccc tgatcgcttc tctggctcca agtctggcaa cacggcctcc ctgaccatct     660
ctgggctcca ggctgaggat gaggctgatt attactgcag ctcatataca agcagcagca     720
ctcatgtctt cggaactggg accaaggtca ccgtcctagg t                         741

SC06-272 amino acid sequence
                             (SEQ ID NO: 340)
QMQLVQSGAEVKKPGSSVKVSCKASGGTFSSYAITWVRQAPGQGLEWMG

GIIGMFGSTYAQNFQGRVTITADESTSTAYMELSSLRSEDTAVYYCARS

TGYYPAYLHHWGQGTLVTVSSGTGGSGGTGSGTGGSTQSALTQPRSVSG
```

SPGQSVTISCTGTSSDVGGYNYVSWYQQHPGKAPKLMIYDVSKRPSGVPD

RFSGSKSGNTASLTISGLQAEDEADYYCSSYTSSSTHVFGTGTKVTVLG

SC06-272 VH amino acid sequence
(SEQ ID NO: 337)
QMQLVQSGAEVKKPGSSVKVSCKASGGTFSSYAITWVRQAPGQGLEWMG

GIIGMFGSTNYAQNFQGRVTITADESTSTAYMELSSLRSEDTAVYYCAR

STGYYPAYLHHWGQGTLVTVSS

SC06-272 VL amino acid sequence
(SEQ ID NO: 338)
QSALTQPRSVSGSPGQSVTISCTGTSSDVGGYNYVSWYQQHPGKAPKLM

IYDVSKRPSGVPDRFSGSKSGNTASLTISGLQAEDEADYYCSSYTSSST

HVFGTGTKVTVLG

The SC06-296 HA-specific single-chain Fv antibody includes a heavy chain variable region (SEQ ID NO: 341) and a light chain variable region (SEQ ID NO: 342) encoded by the nucleic acid sequence shown in SEQ ID NO: 343 and the amino acid sequence shown in SEQ ID NO: 344. The VH-locus is VH1 (1-2) and the VL locus is VKIII (A27).

The amino acids encompassing the CDRs are highlighted in bold in the sequences below. The heavy chain CDRs of the SC06-296 antibody have the following CDR sequences: SYYMH (HCDR1, SEQ ID NO: 603), WINPNSGGT-NYAQKFQG (HCDR2, SEQ ID NO: 604) and EGKWG-PQAAFDI (HCDR3, SEQ ID NO: 605). The light chain CDRs of the SC06-296 antibody have the following CDR sequences: RASQSVSSSYLA (LCDR1, SEQ ID NO: 646), DASSRAT (LCDR2, SEQ ID NO: 607) and QQYGSSLW (LCDR3, SEQ ID NO: 608).

```
SC06-296 nucleotide sequence
                             (SEQ ID NO: 343)
gaggtgcagc tggtggagac cggggctgag gtgaagaagc      60
ctggggcctc agtgaaggtt tcctgcaagg catctggata caccttcacc agctactata     120
tgcactgggt gcgacaggcc cctggacaag ggcttgagtg gatgggatgg atcaaccta      180
acagtggtgg cacaaactat gcacagaagt tccagggcag ggtcaccatg accagggaca     240
cgtccatcag cacagcctac atggagctga gcaggctgag atctgacgac acggccgtgt     300
attactgtgc gagagagggg aaatggggac ctcaagcggc ttttgatatc tggggccaag     360
ggacaatggt caccgtctcg agcggtacgg gcggttcagg cggaaccggc agcggcactg     420
gcgggtcgac ggaaattgtg atgacgcagt ctccaggcac cctgtctttg tctccagggg     480
aaagagccac cctctcctgc agggccagtc agagtgttag cagcagctac ttagcctggt     540
accagcagaa acctggccag gctcccaggc tcctcatcta tgatgcatcc agcagggcca     600
ctgacatccc agacaggttc agtggcagtg ggtctgggac agacttcact ctcaccatca     660
gcagactgga gcctgaagat tttgcagtgt attactgtca gcagtatggt agctcacttt     720
ggacgttcgg ccaagggacc
```

```
aaggtggaga tcaaacgt                                738
```

SC06-296 amino acid sequence
(SEQ ID NO: 344)
EVQLVETGAEVKKPGASVKVSCKASGYTFTSYYMHWVRQAPGQGLEWMG

WINPNSGGTNYAQKFQGRVTMTRDTSISTAYMELSRLRSDDTAVYYCAR

EGKWGPQAAFDIWGQGTMVTVSSGTGGSGGTGSGTGGSTEIVMTQSPGT

LSLSPGERATLSCRASQSVSSSYLAWYQQKPGQAPRLLIYDASSRATDI

PDRFSGSGSGTDFTLTISRLEPEDFAVYYCQQYGSSLWTFGQGTKVEIKR

SC06-296VH amino acid sequence
(SEQ ID NO: 341)
EVQLVETGAEVKKPGASVKVSCKASGYTFTSYYMHWVRQAPGQGLEWMG

WINPNSGGTNYAQKFQGRVTMTRDTSISTAYMELSRLRSDDTAVYYCAR

EGKWGPQAAFDIWGQGTMVTVSS

SC06-296 VL amino acid sequence
(SEQ ID NO: 342)
EIVMTQSPGTLSLSPGERATLSCRASQSVSSSYLAWYQQKPGQAPRLLI

YDASSRATDIPDRFSGSGSGTDFTLTISRLEPEDFAVYYCQQYGSSLWT

FGQGTKVEIKR

The SC06-301 HA-specific single-chain Fv antibody includes a heavy chain variable region (SEQ ID NO: 345) and a light chain variable region (SEQ ID NO: 346) encoded by the nucleic acid sequence shown in SEQ ID NO: 347 and the amino acid sequence shown in SEQ ID NO: 348. The VH-locus is VH1 (3-23) and the VL locus is VKII (A3).

The amino acids encompassing the CDRs are highlighted in bold in the sequences below. The heavy chain CDRs of the SC06-301 antibody have the following CDR sequences: IYAMS (HCDR1, SEQ ID NO: 609), AISSSGDSTYYADS-VKG (HCDR2, SEQ ID NO: 610) and AYGYTFDP (HCDR3, SEQ ID NO: 611). The light chain CDRs of the SC06-301 antibody have the following CDR sequences: RSSQSLLHSNGYNYLD (LCDR1, SEQ ID NO: 612), LGSNRAS (LCDR2, SEQ ID NO: 613) and MQALQTPL (LCDR3, SEQ ID NO: 614).

```
SC06-301 nucleotide sequence
                                        (SEQ ID NO: 347)
gaggtgcagc tggtagagtc tggggggaggc ttggtacagc       60
ctgggggtc cctgagactc tcctgtgcag cctctggatt cacctttagc atctatgcca      120
tgagctgggt ccgccaggca ccagggaagg ggctggagtg ggtctcagct attagtagta      180
gtggtgatag cacatactac gcagactccg tgaagggccg gttcaccatc tccagagaca      240
acgccaggaa cacgctgtat ctgcaaatga acagtctgag agccgaggac acggctgtgt      300
attactgtgc gagagcgtat ggctacacgt tcgaccctg gggccaggga accctggtca       360
ccgtctcgag cggtacgggc ggttcaggcg gaaccggcag cggcactggc gggtcgacgg      420
aaattgtgct gactcagtct ccactctccc tgcccgtcac ccctggagag ccggcctcca      480
tctcctgcag gtctagtcag agcctcctgc atagtaatgg atacaactat ttggattggt      540
acctgcagaa gccagggcag tctccacagc tcctgatcta tttgggttct aatcgggcct      600
ccggggtccc tgacaggttc agtggcagtg gatcaggcac agatttaca ctgaaaatca       660
gcagagtgga ggctgaggat gttggggttt attactgcat gcaagctcta caaactcccc      720
tcactttcgg cggagggacc aaggtggaga tcaaacgt                              738
```

SC06-301 amino acid sequence
(SEQ ID NO: 348)
EVQLVESGGGLVQPGGSLRLSCAASGFTFSIYAMSWVRQAPGKGLEWVS

AISSSGDSTYYADSVKGRFTISRDNARNTLYLQMNSLRAEDTAVYYCAR

AYGYTFDPWGQGTLVTVSSGTGGSGGTGSGTGGSTEIVLTQSPLSLPVT

PGEPASISCRSSQSLLHSNGYNYLDWYLQKPGQSPQLLIYLGSNRASGV

PDRFSGSGSGTDFTLKISRVEAEDVGVYYCMQALQTPLTFGGGTKVEIKR

SC06-301 VH amino acid sequence
(SEQ ID NO: 345)
EVQLVESGGGLVQPGGSLRLSCAASGFTFSIYAMSWVRQAPGKGLEWVS

AISSSGDSTYYADSVKGRFTISRDNARNTLYLQMNSLRAEDTAVYYCAR

AYGYTFDPWGQGTLVTVSS

SC06-301 VL amino acid sequence
(SEQ ID NO: 346)
EIVLTQSPLSLPVTPGEPASISCRSSQSLLHSNGYNYLDWYLQKPGQSP

QLLIYLGSNRASGVPDRFSGSGSGTDFTLKISRVEAEDVGVYYCMQALQ

TPLTFGGGTKVEIKR

The SC06-307 HA-specific single-chain Fv antibody includes a heavy chain variable region (SEQ ID NO: 349) and a light chain variable region (SEQ ID NO: 350) encoded by the nucleic acid sequence shown in SEQ ID NO: 351 and the amino acid sequence shown in SEQ ID NO: 352. The VH-locus is VH3 (3-21) and the VL locus is VKIII (A27).

The amino acids encompassing the CDRs are highlighted in bold in the sequences below. The heavy chain CDRs of the SC06-307 antibody have the following CDR sequences: SYSMN (HCDR1, SEQ ID NO: 615), SISSSSSYIYYVDS-VKG (HCDR2, SEQ ID NO: 616) and GGGSYGAYEGFDY (HCDR3, SEQ ID NO: 617). The light chain CDRs of the SC06-307 antibody have the following CDR sequences: RASQRVSSYLA (LCDR1, SEQ ID NO: 618), GASTRAA (LCDR2, SEQ ID NO: 619) and QQYGRTPLT (LCDR3, SEQ ID NO: 620).

```
SC06-307 nucleotide sequence
                                        (SEQ ID NO: 351)
caggtccagc tggtgcagtc tgggggaggc ctggtcaagc       60
ctggggggtc cctgagactc tcctgtgcag cctctggatt caccttcagt agctatagca      120
tgaactgggt ccgccaggct ccaggaaggg ggctggagtg ggtctcatcc attagtagta      180
gtagtagtta catatactac gtagactcag tgaagggccg attcaccatc tccagagaca      240
acgccaagaa ctcactgtat
```

```
ctgcaaatga acagcctgag agccgaggac acggctgtgt    300
attactgtgc gagaggtggt gggagctacg gggcctacga aggctttgac tactggggcc    360
agggcaccct ggtcaccgtc tcgagcggta cgggcggttc aggcggaacc ggcagcggca    420
ctggcgggtc gacggaaatt gtgctgactc agtctccagg cacccctgtct ttgtctccag    480
gggaaagagc caccctctcc tgcagggcca gtcagcgtgt tagcagctac ttagcctggt    540
accaacagaa acctggccag gctcccaggc tcctcatcta tggtgcatcc accagggccg    600
ctggcatccc agacaggttc agtggcagtg ggtctgggac agacttcact ctcaccatca    660
gcagactgga gcctgaagat tctgcagtgt attactgtca gcagtatggt aggacaccgc    720
tcactttcgg cggagggacc aaggtggaga tcaaacgt                             738

SC06-307 amino acid sequence
                                   (SEQ ID NO: 352)
QVQLVQSGGGLVKPGGSLRLSCAASGFTFSSYSMNWVRQAPGKGLEWVS

SISSSSSYIYYVDSVKGRFTISRDNAKNSLYLQMNSLRAEDTAVYYCAR

GGGSYGAYEGFDYWGQGTLVTVSSGTGGSGGTGSGTGGSTEIVLTQSPG

TLSLSPGERATLSCRASQRVSSYLAWYQQKPGQAPRLLIYGASTRAAGI

PDRFSGSGSGTDFTLTISRLEPEDSAVYYCQQYGRTPLTFGGGTKVEIKR

SC06-307 VH amino acid sequence
                                   (SEQ ID NO: 349)
QVQLVQSGGGLVKPGGSLRLSCAASGFTFSSYSMNWVRQAPGKGLEWVS

SISSSSSYIYYVDSVKGRFTISRDNAKNSLYLQMNSLRAEDTAVYYCAR

GGGSYGAYEGFDYWGQGTLVTVSS

SC06-307 VL amino acid sequence
                                   (SEQ ID NO: 350)
EIVLTQSPGTLSLSPGERATLSCRASQRVSSYLAWYQQKPGQAPRLLIY

GASTRAAGIPDRFSGSGSGTDFTLTISRLEPEDSAVYYCQQYGRTPLTF

GGGTKVEIKR
```

The SC06-310 HA-specific single-chain Fv antibody includes a heavy chain variable region (SEQ ID NO: 353) and a light chain variable region (SEQ ID NO: 354) encoded by the nucleic acid sequence shown in SEQ ID NO: 355 and the amino acid sequence shown in SEQ ID NO: 356. The VH-locus is VH1 (1-69) and the VL locus is VL3 (V2-14).

The amino acids encompassing the CDRs are highlighted in bold in the sequences below. The heavy chain CDRs of the SC06-310 antibody have the following CDR sequences: SYAIS (HCDR1, SEQ ID NO: 571), GIIPIFGTTKYAPKFQG (HCDR2, SEQ ID NO: 572) and HMGYQVRETMDV (HCDR3, SEQ ID NO: 573). The light chain CDRs of the SC06-310 antibody have the following CDR sequences: GGNNIGSKSVH (LCDR1, SEQ ID NO: 621), DDSDRPS (LCDR2, SEQ ID NO: 622) and QVWDSSSDHAV (LCDR3, SEQ ID NO: 623).

```
SC06-310 nucleotide sequence
                                   (SEQ ID NO: 355)
gaggtgcagc tggtggagtc tggggctgag gtgaagaagc     60
ctgggtcctc ggtgaaagtc tcttgcaagg cttctggagg ccccttccgc agctatgcta    120
tcagctgggt gcgacaggcc cctggacaag ggcctgagtg gatgggaggg atcatcccta    180
tttttggtac aacaaaatac gcaccgaagt tccagggcag agtcacgatt accgcggacg    240
atttcgcggg cacagtttac atggagctga gcagcctgcg atctgaggac acggccatgt    300
actactgtgc gaaacatatg gggtaccagg tgcgcgaaac tatggacgtc tggggcaaag    360
ggaccacggt caccgtctcg agcggtacgg gcggttcagg cggaaccggc agcggcactg    420
gcgggtcgac gtcctatgtg ctgactcagc cacctcggt gtcagtggcc ccaggacaga    480
cggccaggat tacctgtggg ggaaacaaca ttggaagtaa aagtgtgcac tggtaccagc    540
agaagccagg ccaggcccct gtgctggtcg tctatgatga tagcgaccgg ccctcaggga    600
tccctgagcg attctctggc tccaactctg gaacacggc caccctgacc atcagcaggg    660
tcgaagccgg ggatgaggcc gactattact gtcaggtgtg ggatagtagt agtgatcatg    720
ctgtgttcgg aggaggcacc cagctgaccg tcctcggt                            738

SC06-310 amino acid sequence
                                   (SEQ ID NO: 356)
EVQLVESGAEVKKPGSSVKVSCKASGGPFRSYAISWVRQAPGQGPEWMG

GIIPIFGTTKYAPKFQGRVTITADDFAGTVYMELSSLRSEDTAMYYCAK

HMGYQVRETMDVWGKGTTVTVSSGTGGSGGTGSGTGGSTSYVLTQPPSV

SVAPGQTARITCGGNNIGSKSVHWYQQKPGQAPVLVVYDDSDRPSGIPE

RFSGSNSGNTATLTISRVEAGDEADYYCQVWDSSSDHAVFGGGTQLTVLG

SC06-310 VH amino acid sequence
                                   (SEQ ID NO: 353)
EVQLVESGAEVKKPGSSVKVSCKASGGPFRSYAISWVRQAPGQGPEWMG

GIIPIFGTTKYAPKFQGRVTITADDFAGTVYMELSSLRSEDTAMYYCAK

HMGYQVRETMDVWGKGTTVTVSS

SC06-310 VL amino acid sequence
                                   (SEQ ID NO: 354)
SYVLTQPPSVSVAPGQTARITCGGNNIGSKSVHWYQQKPGQAPVLVVYD

DSDRPSGIPERFSGSNSGNTATLTISRVEAGDEADYYCQVWDSSSDHAV

FGGGTQLTVLG
```

The SC06-314 HA-specific single-chain Fv antibody includes a heavy chain variable region (SEQ ID NO: 357) and a light chain variable region (SEQ ID NO: 358) encoded by the nucleic acid sequence shown in SEQ ID NO: 359 and the amino acid sequence shown in SEQ ID NO: 360. The VH-locus is VH1 (1-69) and the VL locus is VL1 (V1-17).

The amino acids encompassing the CDRs are highlighted in bold in the sequences below. The heavy chain CDRs of the SC06-314 antibody have the following CDR sequences: SYAIS (HCDR1, SEQ ID NO: 571), GIIPIFGTTKYAPKFQG (HCDR2, SEQ ID NO: 572) and HMGYQVRETMDV (HCDR3, SEQ ID NO: 573). The light chain CDRs of the SC06-314 antibody have the following CDR sequences: SGSSSNIGSNYVY (LCDR1, SEQ ID NO: 624), RDGQRPS (LCDR2, SEQ ID NO: 625) and ATWDDNLSGPV (LCDR3, SEQ ID NO: 626).

```
SC06-314 nucleotide sequence
                                                        (SEQ ID NO: 359)
gaggtgcagc tggtggagtc tggggctgag gtgaagaagc ctgggtcctc ggtgaaagtc    60
tcttgcaagg cttctggagg ccccttccgc agctatgcta tcagctgggt gcgacaggcc   120
cctggacaag ggcctgagtg gatgggaggg atcatcccta tttttggtac aacaaaatac   180
gcaccgaagt tccagggcag agtcacgatt accgcggacg atttcgcggg cacagtttac   240
atggagctga gcagcctgcg atctgaggac acggccatgt actactgtgc gaaacatatg   300
gggtaccagg tgcgcgaaac tatggacgtc tggggcaaag gaccacggt caccgtctcg   360 agcggtacgg gcggttcagg cggaaccggc agcggcactg gcgggtcgac gtcctatgtg   420
ctgactcagc accctcagc gtctgggacc ccgggcaga gggtcaccat ctcttgttct   480
ggaagcagct ccaacatcgg aagtaattat gtatactggt accagcagct cccaggcacg   540
gcccccaaac tcctcatcta tagggatggt cagcggccct caggggtccc tgaccgattc   600
tctggctcca agtctggcac ctcagcctcc ctggccatca gtggactccg gtccgatgat   660
gaggctgatt attactgtgc aacatgggat gacaacctga gtggtccagt attcggcgga   720
gggaccaagc tgaccgtcct aggt                                          744

SC06-314 amino acid sequence
                                                        (SEQ ID NO: 360)
EVQLVESGAEVKKPGSSVKVSCKASGGPFRSYAISWVRQAPGQGPEWMGGIIPIFGTTKYAP

KFQGRVTITADDFAGTVYMELSSLRSEDTAMYYCAKHMGYQVRETMDVWGKGTTVTVSSG

TGGSGGTGSGTGGSTSYVLTQPPSASGTPGQRVTISCSGSSSNIGSNYVYWYQQLPGTAPKLLI

YRDGQRPSGVPDRFSGSKSGTSASLAISGLRSDDEADYYCATWDDNLSGPVFGGGTKLTVLG

SC06-314 VH amino acid sequence
                                                        (SEQ ID NO: 357)
EVQLVESGAEVKKPGSSVKVSCKASGGPFRSYAISWVRQAPGQGPEWMGGIIPIFGTTKYA

PKFQGRVTITADDFAGTVYMELSSLRSEDTAMYYCAKHMGYQVRETMDVWGKGTTVTVSS

SC06-314 VL amino acid sequence
                                                        (SEQ ID NO: 358)
SYVLTQPPSASGTPGQRVTISCSGSSSNIGSNYVYWYQQLPGTAPKWYRDGQRPSGVPDRF

SGSKSGTSASLAISGLRSDDEADYYCATWDDNLSGPVFGGGTKLTVLG
```

The SC06-323 HA-specific single-chain Fv antibody includes a heavy chain variable region (SEQ ID NO: 361) and a light chain variable region (SEQ ID NO: 362) encoded by the nucleic acid sequence shown in SEQ ID NO: 363 and the amino acid sequence shown in SEQ ID NO: 364. The VH-locus is VH1 (1-69) and the VL locus is VKIII (A27).

The amino acids encompassing the CDRs are highlighted in bold in the sequences below. The heavy chain CDRs of the SC06-323 antibody have the following CDR sequences: SYGIS (HCDR1, SEQ ID NO: 627), DIIGMFGSTNYAQN-FQG (HCDR2, SEQ ID NO: 628) and SSGYYPAYLPH (HCDR3, SEQ ID NO: 629). The light chain CDRs of the SC06-323 antibody have the following CDR sequences: RASQSVSSSYLA (LCDR1, SEQ ID NO: 646), GASSRAT (LCDR2, SEQ ID NO: 631) and QQYGSSPRT (LCDR3, SEQ ID NO: 632).

```
SC06-323 nucleotide sequence
                                                     (SEQ ID NO: 363)
gaggtgcagc tggtggagtc tggggctgag gtgaagaagc cagggtcctc ggtgaaggtc    60
tcctgtaagg cctctggagg caccttctcc agctatggta tcagctgggt gcgacaggcc   120
cctggacaag ggcttgagtg gatgggagac atcatcggta tgtttggttc aacaaactac   180
gcacagaact tccagggcag actcacgatt accgcggacg aatccacgag cacagcctac   240
atggagctga gcagcctgag atctgaggac acggccgtgt attactgtgc gagaagtagt   300
ggttattacc ctgcatacct ccccactgg ggccagggca ccttggtcac cgtctcgagc   360
ggtacgggcg gttcaggcgg aaccggcagc ggcactggcg ggtcgacgga aattgtgttg   420
acccagtctc caggcaccct gtctttgtct ccagggaaa gagccaccct ctcctgcagg   480
gccagtcaga gtgttagcag cagctactta gcctggtacc agcagaaacc tggccaggct   540
cccaggctcc tcatctatgg tgcatccagc agggccactg gcatcccaga caggttcagt   600
ggcagtgggt ctgggacaga cttcactctc accatcagca gactggagcc tgaagatttt   660
gcagtgtatt actgtcagca gtatggtagc tcacccagaa ctttcggcgg agggaccaag   720
gtggagatca aacgt                                                    735

SC06-323 amino acid sequence
                                                     (SEQ ID NO: 364)
EVQLVESGAEVKKPGSSVKVSCKASGGTFSSYGISWVRQAPGQGLEWMGDIIGMFGSTNYA

QNFQGRLTITADESTSTAYMELSSLRSEDTAVYYCARSSGYYPAYLPHWGQGTLVTVSSGTG

GSGGTGSGTGGSTEIVLTQSPGTLSLSPGERATLSCRASQSVSSSYLAWYQQKPGQAPRLLIY

GASSRATGIPDRFSGSGSGTDFTLTISRLEPEDFAVYYCQQYGSSPRTFGGGTKVEIKR

SC06-323 VH amino acid sequence
                                                     (SEQ ID NO: 361)
EVQLVESGAEVKKPGSSVKVSCKASGGTFSSYGISWVRQAPGQGLEWMGDIIGMFGSTNYA

QNFQGRLTITADESTSTAYMELSSLRSEDTAVYYCARSSGYYPAYLPHWGQGTLVTVSS

SC06-323 VL amino acid sequence
                                                     (SEQ ID NO: 362)
EIVLTQSPGTLSLSPGERATLSCRASQSVSSSYLAWYQQKPGQAPRLLIYGASSRATGIPDRFS

GSGSGTDFTLTISRLEPEDFAVYYCQQYGSSPRTFGGGTKVEIKR
```

The SC06-325 HA-specific single-chain Fv antibody includes a heavy chain variable region (SEQ ID NO: 365) and a light chain variable region (SEQ ID NO: 366) encoded by the nucleic acid sequence shown in SEQ ID NO: 367 and the amino acid sequence shown in SEQ ID NO: 368. The VH-locus is VH1 (1-69) and the VL locus is VL2 (V1-4).

The amino acids encompassing the CDRs are highlighted in bold in the sequences below. The heavy chain CDRs of the SC06-325 antibody have the following CDR sequences: FYSMS (HCDR1, SEQ ID NO: 633), GIIPMFGTTNYAQK-FQG (HCDR2, SEQ ID NO: 634) and GDKGIYYYYMDV (HCDR3, SEQ ID NO: 635). The light chain CDRs of the SC06-325 antibody have the following CDR sequences: TGTSSDVGGYNYVS (LCDR1, SEQ ID NO: 577), EVSN-RPS (LCDR2, SEQ ID NO: 578) and SSYTSSSTLV (LCDR3, SEQ ID NO: 636).

```
SC06-325 nucleotide sequence
                                                 (SEQ ID NO: 367)
gaggtgcagc tggtggagtc tggggctgag gtgaagaagc cggggtcctc ggtgaaggtc    60
tcctgcaagg cttctggagg caccttcagc ttctattcta tgagctgggt gcgacaggcc   120
cctggacaag gacttgagtg gatgggaggg atcatcccta tgtttggtac aacaaactac   180
gcacagaagt tccagggcag agtcacgatt accgcggtcg aatccacgag cacagcctac   240
atggaggtga gcagcctgag atctgaggac acggccgttt attactgtgc gagaggtgat   300
aagggtatct actactacta catggacgtc tggggcaaag ggaccacggt caccgtctcg   360
agcggtacgg gcggttcagg cggaaccggc agcggcactg gcgggtcgac gcagtctgcc   420
ctgactcagc ctgcctccgt gtctgggtct cctggacagt cgatcaccat ctcctgcact   480
ggaaccagca gtgacgttgg tggttataac tatgtctcct ggtaccaaca gcacccaggc   540
aaagccccca aactcatgat ttatgaggtc agtaatcggc cctcaggggt ttctaatcgc   600
ttctctggct ccaagtctgg caacacggcc tccctgacca tctctgggct ccaggctgag   660
gacgaggctg attattactg cagctcatat acaagcagca gcactcttgt cttcggaact   720
gggaccaagg tcaccgtcct aggt                                          744

SC06-325 amino acid sequence
                                                 (SEQ ID NO: 368)
EVQLVESGAEVKKPGSSVKVSCKASGGTFSFYSMSWVRQAPGQGLEWMGGIIPMFGTTNYA

QKFQGRVTITAVESTSTAYMEVSSLRSEDTAVYYCARGDKGIYYYYMDVWGKGTTVTVSSG

TGGSGGTGSGTGGSTQSALTQPASVSGSPGQSITISCTGTSSDVGGYNYVSWYQQHPGKAPK

LMIYEVSNRPSGVSNRFSGSKSGNTASLTISGLQAEDEADYYCSSYTSSSTLVFGTGTKVTVLG

SC06-325 VH amino acid sequence
                                                 (SEQ ID NO: 365)
EVQLVESGAEVKKPGSSVKVSCKASGGTFSFYSMSWVRQAPGQGLEWMGGIIPMFGTTNY

AQKFQGRVTITAVESTSTAYMEVSSLRSEDTAVYYCARGDKGIYYYYMDVWGKGTTVTVSS

SC06-325 VL amino acid sequence
                                                 (SEQ ID NO: 366)
QSALTQPASVSGSPGQSITISCTGTSSDVGGYNYVSWYQQHPGKAPKLMIYEVSNRPSGVSN

RFSGSKSGNTASLTISGLQAEDEADYYCSSYTSSSTLVFGTGTKVTVLG
```

The SC06-327 HA-specific single-chain Fv antibody includes a heavy chain variable region (SEQ ID NO: 369) and a light chain variable region (SEQ ID NO: 370) encoded by the nucleic acid sequence shown in SEQ ID NO: 371 and the amino acid sequence shown in SEQ ID NO: 372. The VH-locus is VH1 (1-69) and the VL locus is VL3 (V2-14).

The amino acids encompassing the CDRs are highlighted in bold in the sequences below. The heavy chain CDRs of the SC06-327 antibody have the following CDR sequences: THAIS (SEQ ID NO: 637), GIIAIFGTANYAQKFQG (SEQ ID NO: 638) and GSGYHISTPFDN (SEQ ID NO: 639). The light chain CDRs of the SC06-327 antibody have the following CDR sequences: GGNNIGSKGVH (SEQ ID NO: 640), DDSDRPS (SEQ ID NO: 622) and QVWDSSSDHVV (SEQ ID NO: 642).

```
SC06-327 nucleotide sequence
                                                       (SEQ ID NO: 371)
gaggtgcagc tggtggagac cggggctgag gtgaagaagc ctgggtcctc ggtgaaggtc   60
tcctgcaagg cctctggagg caccttcagg acccatgcta tcagttgggt gcgacaggcc  120
cctggacaag ggcttgagtg gatgggaggg atcatcgcta tcttcggaac agcaaactac  180
gcacagaagt tccagggcag aatcacgatt accgcggacg aatccacgag tacagcctac  240
atggagctga gcagcctgag atctgaggac acggccgtgt atttctgtgc gagaggcagt  300
ggttatcata tatcgacacc ctttgacaac tggggccagg gaaccctggt caccgtctcg  360
agcggtacgg gcggttcagg cggaaccggc agcggcactg gcgggtcgac gtcctatgtg  420
ctgactcagc caccctcggt gtcagtggcc ccaggacaga cggccaggat tacctgtggg  480
ggaaacaaca ttggaagtaa aggtgtgcac tggtaccagc agaagcctgg ccaggcccct  540
gtgctggtcg tctatgatga tagcgaccgg ccctcaggga tccctgagcg attctctggc  600
tccaactctg gaacacggc caccctgacc atcagcaggg tcgaagccgg ggatgaggcc  660
gactattact gtcaggtgtg ggatagtagt agtgatcatg tggtattcgg cggagggacc  720
aagctgaccg tcctaggt                                                738

SC06-327 amino acid sequence
                                                       (SEQ ID NO: 372)
EVQLVETGAEVKKPGSSVKVSCKASGGTFRTHAISWVRQAPGQGLEWMGGIIAIFGTANYA

QKFQGRITITADESTSTAYMELSSLRSEDTAVYFCARGSGYHISTPFDNWGQGTLVTVSSG

TGGSGGTGSGTGGSTSYVLTQPPSVSVAPGQTARITCGGNNIGSKGVHWYQQKPGQAPVLV

VYDDSDRPSGIPERFSGSNSGNTATLTISRVEAGDEADYYCQVWDSSSDHVVFGGGTKLTVLG

SC06-327 VH amino acid sequence
                                                       (SEQ ID NO: 369)
EVQLVETGAEVKKPGSSVKVSCKASGGTFRTHAISWVRQAPGQGLEWMGGIIAIFGTANYA

QKFQGRITITADESTSTAYMELSSLRSEDTAVYFCARGSGYHISTPFDNWGQGTLVTVSS

SC06-327 VL amino acid sequence
                                                       (SEQ ID NO: 370)
SYVLTQPPSVSVAPGQTARITCGGNNIGSKGVHWYQQKPGQAPVLVVYDDSDRPSGIPERFS

GSNSGNTATLTISRVEAGDEADYYCQVWDSSSDHVVFGGGTKLTVLG
```

The SC06-328 HA-specific single-chain Fv antibody includes a heavy chain variable region (SEQ ID NO: 373) and a light chain variable region (SEQ ID NO: 374) encoded by the nucleic acid sequence shown in SEQ ID NO: 375 and the amino acid sequence shown in SEQ ID NO: 376. The VH-locus is VH1 (1-69) and the VL locus is VKIII (A27).

The amino acids encompassing the CDRs are highlighted in bold in the sequences below. The heavy chain CDRs of the SC06-328 antibody have the following CDR sequences: GYAIS (HCDR1, SEQ ID NO: 643), GIIPIFGTTNYAQKFQG (HCDR2, SEQ ID NO: 644) and VKDGYCTLTSCPVGWYFDL (HCDR3, SEQ ID NO: 645). The light chain CDRs of the SC06-328 antibody have the following CDR sequences: RASQSVSSSYLA (LCDR1, SEQ ID NO: 646), GASSRAT (LCDR2, SEQ ID NO: 631) and QQYGSSLT (LCDR3, SEQ ID NO: 648).

SC06-328 nucleotide sequence (SEQ ID NO: 375)

```
gaggtgcagc tggtggagtc tggggctgag gtgaagaagc ctgggtcctc ggtgaaggtc   60
tcctgcaagg cttctggaca catcttcagc ggctatgcaa tcagttgggt gcgacaggcc  120
cctggacaag ggcttgagtg gatgggaggg atcatcccta tctttggtac aacaaactac  180
gcacagaagt tccagggcag agtcacgatt accgcggacc aatccacgag cacagcctac  240
atggacctga gcaacttgag atctgaggac acggccgtct attactgtgc gagagtgaaa  300
gatggatatt gtactcttac cagctgccct gtcggctggt acttcgatct ctggggccgt  360
ggcaccctgg tcactgtctc gagcggtacg ggcggttcag gcggaaccgg cagcggcact  420
ggcgggtcga cggaaattgt gatgacgcag tctccaggca ccctgtcttt gtctccaggg  480
gaaagagcca ccctctcgtg cagggccagt cagagtgtta gcagcagcta cttagcctgg  540
taccagcaga aacctggcca ggctcccagg ctcctcatct ttggtgcctc cagcagggcc  600
actggcatcc cagacaggtt cagtggcagt gggtctggga cagacttcac tctcaccatc  660
agcagactgg agcctgaaga ttttgcagtg tattactgtc agcagtatgg tagctcactc  720
actttcggcg gagggaccaa gctggagatc aaacgt                            756
```

SC06-328 amino acid sequence (SEQ ID NO: 376)

EVALVESGAEVKKPGSSVKVSCKASGHIFSGYAISWVRQAPGQGLEWMGGIIPIFGTTNYAQ

KFQGRVTITADQSTSTAYMDLSNLRSEDTAVYYCARVKDGYCTLTSCPVGWYFDLWGRGTL

VTVSSGTGGSGGTGSGTGGSTEIVMTQSPGTLSLSPGERATLSCRASQSVSSSYLAWYQ

QKPGQAPRLLIFGASSRATGIPDRFSGSGSGTDFTLTISRLEPEDFAVYYCQQYGSSLT

FGGGTKLEIKR

SC06-328 VH amino acid sequence (SEQ ID NO: 373)

EVALVESGAEVKKPGSSVKVSCKASGHIFSGYAISWVRQAPGQGLEWMGGIIPIFGTTNYA

QKFQGRVTITADQSTSTAYMDLSNLRSEDTAVYYCARVKDGYCTLTSCPVGWYFDLWGR

GTLVTVSS

SC06-328 VL amino acid sequence (SEQ ID NO: 374)

EIVMTQSPGTLSLSPGERATLSCRASQSVSSSYLAWYQQKPGQAPRLLIFGASSRATG

IPDRFSGSGSGTDFTLTISRLEPEDFAVYYCQQYGSSLTFGGGTKLEIKR

The SC06-329 HA-specific single-chain Fv antibody includes a heavy chain variable region (SEQ ID NO: 377) and a light chain variable region (SEQ ID NO: 378) encoded by the nucleic acid sequence shown in SEQ ID NO: 379 and the amino acid sequence shown in SEQ ID NO: 380. The VH-locus is VH1 (1-69) and the VL locus is VKIII (A27).

The amino acids encompassing the CDRs are highlighted in bold in the sequences below. The heavy chain CDRs of the SC06-329 antibody have the following CDR sequences: SNSIS (HCDR1, SEQ ID NO: 649), GIFALFGTTDYAQK-FQG (HCDR2, SEQ ID NO: 650) and GSGYTTRNYFDY (HCDR3, SEQ ID NO: 651). The light chain CDRs of the SC06-329 antibody have the following CDR sequences: RASQSVSSNYLG (LCDR1, SEQ ID NO: 652), GASSRAS (LCDR2, SEQ ID NO: 653) and QQYGSSPLT (LCDR3, SEQ ID NO: 654).

```
SC06-329 nucleotide sequence
                                                     (SEQ ID NO: 379)
gaggtccagc tggtacagtc tggggctgag gttaagaagc ctgggtcctc ggtgaaggtc   60
tcctgcaagg cttctggagg catcttcaga agcaattcta tcagttgggt gcgacaggcc  120
cctgggcaag ggcttgagtg gatgggaggg atcttcgctc ttttcggaac aacagactac  180
gcgcagaagt tccagggcag agtcacgatt accgcggacg aatcttcgac cacagtctac  240
ctggagctga gtagcctgac atctgaggac acggccgttt attactgtgc gagaggcagt  300
ggctacacca cacgcaacta ctttgactac tggggccagg gcaccctggt caccgtctcg  360
agcggtacgg gcggttcagg cggaaccggc agcggcactg gcgggtcgac ggaaattgtg  420
ctgactcagt ctccaggcac cctgtctttg tctccagggg aaagagccac actctcctgc  480
agggccagtc agagtgttag cagcaactac ttaggctggt accagcagaa acctggccag  540
gctcccaggc tcctgatcta tggtgcatcc agcagggcca gtggcatccc agacaggttc  600
agtggcggtg ggtctgggac agacttcact ctcaccatca gcagactgga gcctgaagat  660
tttgcagtgt attactgtca gcagtatggt agctcacccc tcactttcgg cggagggacc  720
aaggtggaga tcaaacgt                                                 738

SC06-329 amino acid sequence
                                                     (SEQ ID NO: 380)
EVQLVQSGAEVKKPGSSVKVSCKASGGIFRSNSISWVRQAPGQGLEWMGGIFALFGTTDYAQ

KFQGRVTITADESSTTVYLELSSLTSEDTAVYYCARGSGYTTRNYFDYWGQGTLVTVSSGTG

GSGGTGSGTGGSTEIVLTQSPGTLSLSPGERATLSCRASQSVSSNYLGWTQQKPGQAPRLLIY

GASSRASGIPDRFSGGGSGTDFTLTISRLEPEDFAVYYCQQYGSSPLTFGGGTKVEIKR

SC06-329 VH amino acid sequence
                                                     (SEQ ID NO: 377)
EVQLVQSGAEVKKPGSSVKVSCKASGGIFRSNSISWVRQAPGQGLEWMGGIFALFGTTDYA

QKFQGRVTITADESSTTVYLELSSLTSEDTAVYYCARGSGYTTRNYFDYWGQGTLVTVSS

SC06-329 VL amino acid sequence
                                                     (SEQ ID NO: 378)
EIVLTQSPGTLSLSPGERATLSCRASQSVSSNYLGWTQQKPGQAPRLLIYGASSRASGIPDRFS

GGGSGTDFTLTISRLEPEDFAVYYCQQYGSSPLTFGGGTKVEIKR
```

The SC06-331 HA-specific single-chain Fv antibody includes a heavy chain variable region (SEQ ID NO: 381) and a light chain variable region (SEQ ID NO: 382) encoded by the nucleic acid sequence shown in SEQ ID NO: 383 and the amino acid sequence shown in SEQ ID NO: 384. The VH-locus is VH1 (1-69) and the VL locus is VL3 (V2-14).

The amino acids encompassing the CDRs are highlighted in bold in the sequences below. The heavy chain CDRs of the SC06-331antibody have the following CDR sequences: SYAIS (HCDR1, SEQ ID NO: 571), GIIGMFGTANYAQKFQG (HCDR2, SEQ ID NO: 655) and GNYYYESSLDY (HCDR3, SEQ ID NO: 656). The light chain CDRs of the SC06-331 antibody have the following CDR sequences: GGNNIGSKSVH (LCDR1, SEQ ID NO: 621), DDSDRPS (LCDR2, SEQ ID NO: 622) and QVWDSSSDH (LCDR3, SEQ ID NO: 657).

```
SC06-331 nucleotide sequence
                                                       (SEQ ID NO: 383)
gaggtgcagc tggtggagtc tggggctgag gtgaagaagc ctgggtcctc ggtgaaggtc   60
tcctgcaagg cttctggagg caccttcagc agctatgcta tcagctgggt gcgacaggcc  120
cctggacaag ggcttgagtg gatgggaggg atcatcggta tgttcggtac agcaaactac  180
gcacagaagt tccagggcag agtcacgatt accgcggacg aatttacgag cacagcctac  240
atggagctga gcagcctgag atctgaggac acggccgtgt attactgtgc gagaggaaat  300
tattactatg agagtagtct cgactactgg ggccagggaa ccctggtcac cgtctcgagc  360
ggtacgggcg gttcaggcgg aaccggcagc ggcactggcg ggtcgacgca gtctgtcgtg  420
acgcagccgc cctcggtgtc agtggcccca ggacagacgg ccaggattac ctgtggggga  480
aacaacattg gaagtaaaag tgtgcactgg taccagcaga agccaggcca ggcccctgtg  540
ctggtcgtct atgatgatag cgaccggccc tcagggatcc ctgagcgatt ctctggctcc  600
aactctggga acacggccac cctgaccatc agcagggtcg aagccgggga tgaggccgac  660
tattactgtc aggtgtggga tagtagtagt gatcattatg tcttcggaac tgggaccaag  720
gtcaccgtcc taggt                                                   735

SC06-331 amino acid sequence
                                                       (SEQ ID NO: 384)
EVQLVESGAEVKKPGSSVKVSCKASGGTFSSYAISWVRQAPGQGLEWMGGIIGMFGTANYA

QKFQGRVTITADEFTSTAYMELSSLRSEDTAVYYCARGNYYYESSLDYWGQGTLVTVSSGT

GGSGGTGSGTGGSTQSVVTQPPSVSVAPGQTARITCGGNNIGSKSVHWYQQKPGQAPVLVV

YDDSDRPSGIPERFSGSNSGNTATLTISRVEAGDEADYYCQVWDSSSDHYVFGTGTKVTVLG
```

SC06-331 VH amino acid sequence (SEQ ID NO: 381)

EVQLVESGAEVKKPGSSVKVSCKASGGTFSSYAISWVRQAPGQGLEWMGGIIGMFGTANY

AQKFQGRVTITADEFTSTAYMELSSLRSEDTAVYYCARGNYYYESSLDYWGQGTLVTVSS

SC06-331 VL amino acid sequence (SEQ ID NO: 382)

QSVVTQPPSVSVAPGQTARITCGGNNIGSKSVHWYQQKPGQAPVLVVYDDSDRPSGIPERFS

GSNSGNTATLTISRVEAGDEADYYCQVWDSSSDHYVFGTGTKVTVLG

The SC06-332 HA-specific single-chain Fv antibody includes a heavy chain variable region (SEQ ID NO: 385) and a light chain variable region (SEQ ID NO: 386) encoded by the nucleic acid sequence shown in SEQ ID NO: 387 and the amino acid sequence shown in SEQ ID NO: 388. The VH-locus is VH1 (1-69) and the VL locus is VKI (A20).

The amino acids encompassing the CDRs are highlighted in bold in the sequences below. The heavy chain CDRs of the SC06-332 antibody have the following CDR sequences: NFAIN (HCDR1, SEQ ID NO: 658), GIIAVFGTTKYAHKFQG (HCDR2, SEQ ID NO: 659) and GPHYYSSYMDV (HCDR3, SEQ ID NO: 660). The light chain CDRs of the SC06-332 antibody have the following CDR sequences: RASQGISTYLA (LCDR1, SEQ ID NO: 661), AASTLQS (LCDR2, SEQ ID NO: 662) and QKYNSAPS (LCDR3, SEQ ID NO: 663).

```
SC06-332 nucleotide sequence
                                                  (SEQ ID NO: 387)
caggtgcagc tggtgcagtc tggggctgag gtgaagaagc ctgggtcctc ggtaaaggtc   60
tcctgcaagg cttctggagg ccccttccgc aattttgcta tcaactgggt gcgacaggcc  120
cctggacaag ggcttgagtg gatgggaggg atcatcgctg tctttgggac gacaaagtac  180
gcacataagt tccagggcag agtcaccatc accgcggacg actccacaaa tacagcttac  240
atggagctgg gcagcctgaa atctgaggac acggccgtgt attactgtgc gagaggtccc  300
cactactact cctcctacat ggacgtctgg ggcgaaggga ccacggtcac cgtctcgagc  360
ggtacgggcg gttcaggcgg aaccggcagc ggcactggcg gtcgacgga catccagttg  420 acccagtctc catcctccct gtctgcatct gtaggagaca gagtcaccat cacttgccgg  480
gcgagtcagg gcattagcac ttatttagcc tggtatcagc agaaacccgg gaaagttcct  540
aaactcctga tctatgctgc atccactttg caatcagggg tcccatctcg gttcagtggc  600
agtggatctg ggacagattt cactctcacc atcagcagcc tgcagcctga agatgttgca  660
acttattact gtcaaaagta taacagtgcc ccttctttcg gccctgggac caaagtggat  720
atcaaacgt                                                          729

SC06-332 amino acid sequence
                                                  (SEQ ID NO: 388)
QVQLVQSGAEVKKPGSSVKVSCKASGGPFRNFAINWVRQAPGQGLEWMGGIIAVFGTTKYA

HKFQGRVTITADDSTNTAYMELGSLKSEDTAVYYCARGPHYYSSYMDVWGEGTTVTVSSGT

GGDGGTGSGTGGSTDIQLTQSPSSLSASVGDRVTITCRASQGISTYLAWYQQKPGKVPKLLIY

AASTLQSGVPSRFSGSGSGTDFTLTISSLQPEDVATYYCQKYNSAPSFGPGTKVDIKR

SC06-332 VH amino acid sequence
                                                  (SEQ ID NO: 385)
QVQLVQSGAEVKKPGSSVKVSCKASGGPFRNFAINWVRQAPGQGLEWMGGIIAVFGTTKY

AHKFQGRVTITADDSTNTAYMELGSLKSEDTAVYYCARGPHYYSSYMDVWGEGTTVTVSS

SC06-332 VL amino acid sequence
                                                  (SEQ ID NO: 386)
DIQLTQSPSSLSASVGDRVTITCRASQGISTYLAWYQQKPGKVPKLLIYAASTLQSGVPSRFS

GSGSGTDFTLTISSLQPEDVATYYCQKYNSAPSFGPGTKVDIKR
```

The SC06-334 HA-specific single-chain Fv antibody includes a heavy chain variable region (SEQ ID NO: 389) and a light chain variable region (SEQ ID NO: 390) encoded by the nucleic acid sequence shown in SEQ ID NO: 391 and the amino acid sequence shown in SEQ ID NO: 392. The VH-locus is VH1 (1-69) and the VL locus is VL3 (V2-14).

The amino acids encompassing the CDRs are highlighted in bold in the sequences below. The heavy chain CDRs of the SC06-334 antibody have the following CDR sequences: SNAVS (HCDR1, SEQ ID NO: 664), GILGVFGSPSYAQK-FQG (HCDR2, SEQ ID NO: 665) and GPTYYYSYMDV (HCDR3, SEQ ID NO: 666). The light chain CDRs of the SC06-334 antibody have the following CDR sequences: GGNNIGRNSVH (LCDR1, SEQ ID NO: 667), DDSDRPS (LCDR2, SEQ ID NO: 622) and QVWHSSSDHYV (LCDR3, SEQ ID NO: 669).

```
SC06-334 nucleotide sequence
                                                       (SEQ ID NO: 391)
gaggtgcagc tggtggagac tggggctgag gtgaagaagc ctgggtcctc ggtgaaggtc   60
ccctgcaaat cttctggaag ccccttcagg agtaatgctg tcagctgggt gcgacaggcc  120
cccggacaag gcttgagtg gtgggagga atcctcggtg tctttggttc accaagctac   180
gcacagaagt tccagggcag agtcacgatt accgcggacg aatccaccaa cacagtccac  240
atggagctga gaggtttgag atctgaggac acggccgtgt attattgtgc gagaggtcct  300
acctactact actcctacat ggacgtctgg ggcaaaggga ccacggtcac cgtctcgagc  360
ggtacgggcg gttcaggcgg aaccggcagc ggcactggcg ggtcgacgtc ctatgtgctg  420
actcagccac cctcggagtc agtggcccca ggacagacgg ccaggattac ctgtggggga  480
aataacattg gaagaaatag tgtgcactgg tatcagcaga agccaggcca ggcccctgtg  540
ctggtcgtgt atgatgatag cgaccggccc tcagggatcc ctgagcgatt ttctggctcc  600
aagtctggga acacggccac cctgattatc agcagggtcg aagtcgggga tgaggccgac  660
tactactgtc aggtgtggca tagtagtagt gatcattatg tcttcggaac tgggaccaag  720
gtcaccgtcc taggt                                                   735

SC06-334 amino acid sequence
                                                       (SEQ ID NO: 392)
EVALVETGAEVKKPGSSVKVPCKSSGSPFRSNAVSWVRQAPGQGLEWVGGILGVFGSPSYA

QKFQGRVTITADESTNTVHMELRGLRSEDTAVYYCARGPTYYYSYMDVWGKGTTVTVSSG

TGGSGGTGSGTGGSTSYVLTQPPSESVAPGQTARITCGGNNIGRNSVHWYQQKPGQAPVLVV

YDDSDRPSGIPERFSGSKSGNTATLIISRVEVGDEADYYCQVWHSSSDHYVFGTGTKVTVLG

SC06-334 VH amino acid sequence
                                                       (SEQ ID NO: 389)
EVALVETGAEVKKPGSSVKVPCKSSGSPFRSNAVSWVRQAPGQGLEWVGGILGVFGSPSYA

QKFQGRVTITADESTNTVHMELRGLRSEDTAVYYCARGPTYYYSYMDVWGKGTTVTVSS

SC06-334 VL amino acid sequence
                                                       (SEQ ID NO: 390)
SYVLTQPPSESVAPGQTARITCGGNNIGRNSVHWYQQKPGQAPVLVVYDDSDRPSGIPERFS

GSKSGNTATLIISRVEVGDEADYYCQVWHSSSDHYVFGTGTKVTVLG
```

The SC06-336 HA-specific single-chain Fv antibody includes a heavy chain variable region (SEQ ID NO: 393) and a light chain variable region (SEQ ID NO: 394) encoded by the nucleic acid sequence shown in SEQ ID NO: 395 and the amino acid sequence shown in SEQ ID NO: 396. The VH-locus is VH1 (1-69) and the VL locus is VKIII (A27).

The amino acids encompassing the CDRs are highlighted in bold in the sequences below. The heavy chain CDRs of the SC06-336 antibody have the following CDR sequences: SYAIS (HCDR1, SEQ ID NO: 670), GIFGMFGTANYAQK-FQG (HCDR2, SEQ ID NO: 671) and SSGYYPQYFQD (HCDR3, SEQ ID NO: 672). The light chain CDRs of the SC06-336 antibody have the following CDR sequences: RASQSVSSSYLA (LCDR1, SEQ ID NO: 646), GASSRAT (LCDR2, SEQ ID NO: 631) and QQYGSSSLT (LCDR3, SEQ ID NO: 308).

```
SC06-336 nucleotide sequence
                                                            (SEQ ID NO: 395)
cagatgcagc tggtacaatc tggagctgag gtgaagaagc ctgggtcctc ggtgaaggtc    60
tcctgcaagg cttctggagg caccttcagc agctatgcta tcagctgggt gcgacaggcc   120
cctggacaag ggcttgagtg gatgggaggg atcttcggta tgtttgggac agcaaactac   180
gcgcagaagt tccagggcag agtcacgatt accgcggacg aattcacgag cgcggcctac   240
atggagctga gcagcctggg atctgaggac acggccatgt attactgtgc gaggtctagt   300
ggttattacc cccaatactt ccaggactgg ggccagggca cctggtcac cgtctcgagc   360 ggtacgggcg gttcaggcgg aaccggcagc ggcactggcg ggtcgacgga aattgtgatg   420
acacagtctc caggcaccct gtctttgtct ccagggcaaa gagccaccct ctcctgcagg   480
gccagtcaga gtgttagcag cagctactta gcctggtacc agcagaaacc tggccaggct   540
cccagactcc tcatgtatgg tgcatccagc agggccactg gcatcccaga caggttcagt   600
ggcagtgggt ctgggacaga cttcactctc accatcagca gactggagcc tgaagatttt   660
gcagtgtatt actgtcagca gtatggtagc tcatcgctca ctttcggcgg agggaccaag   720
ctggagatca aacgt                                                    735

SC06-336 amino acid sequence
                                                            (SEQ ID NO: 396)
QMQLVQSGAEVKKPGSSVKVSCKASGGTFSSYAISWVRQAPGQGLEWMGGIFGMFGTANY

AQKFQGRVTITADEFTSAAYMELSSLGSEDTAMYYCARSSGYYPQYFQDWGQGTLVTVSSG

TGGSGGTGSGTGGSTEIVMTQSPGTLSLSPGQRATLSCRASQSVSSSYLAWYQQKPGQAPRL

LMYGASSRATGIPDRFSGSGSGTDFTLTISRLEPEDFAVYYCQQYGSSSLTFGGGTKLEIKR

SC06-336 VH amino acid sequence
                                                            (SEQ ID NO: 393)
QMQLVQSGAEVKKPGSSVKVSCKASGGTFSSYAISWVRQAPGQGLEWMGGIFGMFGTAN

YAQKFQGRVTITADEFTSAAYMELSSLGSEDTAMYYCARSSGYYPQYFQDWGQGTLVTVSS

SC06-336 VL amino acid sequence
                                                            (SEQ ID NO: 394)
EIVMTQSPGTLSLSPGQRATLSCRASQSVSSSYLAWYQQKPGQAPRLLMYGASSRATGIPDR

FSGSGSGTDFTLTISRLEPEDFAVYYCQQYGSSSLTFGGGTKLEIKR
```

The SC06-339 HA-specific single-chain Fv antibody includes a heavy chain variable region (SEQ ID NO: 397) and a light chain variable region (SEQ ID NO: 398) encoded by the nucleic acid sequence shown in SEQ ID NO: 399 and the amino acid sequence shown in SEQ ID NO: 400. The VH-locus is VH1 (1-69) and the VL locus is VL3 (V2-14).

The amino acids encompassing the CDRs are highlighted in bold in the sequences below. The heavy chain CDRs of the SC06-339 antibody have the following CDR sequences: SYAIS (HCDR1, SEQ ID NO: 303), GIIAIFHTPKYAQK-FQG (HCDR2, SEQ ID NO: 306) and GSTYDFSSGLDY (HCDR3, SEQ ID NO: 725). The light chain CDRs of the SC06-339 antibody have the following CDR sequences: GGNNIGSKSVH (LCDR1, SEQ ID NO: 621), DDSDRPS (LCDR2, SEQ ID NO: 622) and QVWDSSSDHVV (LCDR3, SEQ ID NO: 642).

```
SC06-339 nucleotide sequence
                                                       (SEQ ID NO: 399)
gaggtgcagc tggtggagtc cggggctgag gtgaagaagc ctgggtcctc ggtgaaggtc   60
tcctgcaagg cttctggagg catcttcaac agttatgcta tcagctgggt gcgacaggcc  120
cctggacaag gcttgagtg gatgggaggc atcatcgcta tctttcatac accaaagtac  180
gcacagaagt tccagggcag agtcacgatt accgcggacg aatccacgaa cacagcctac  240
atggaactga aagcctgaa atctgaggac acggccctgt attactgtgc gagagggtcc  300
acttacgatt tttcgagtgg ccttgactac tggggccagg gaaccctggt caccgtctcg  360
agcggtacgg gcggttcagg cggaaccggc agcggcactg gcgggtcgac gcaggcaggg  420
ctgactcagc caccctcggt gtcagtggcc ccaggacaga cggccaggat tacctgtggg  480
ggaaacaaca ttggaagtaa aagtgtgcac tggtaccagc agaagccagg ccaggcccct  540
gtcctagtcg tctatgatga tagcgaccgg ccctcaggga tccctgagcg attctctggc  600
tccaactctg ggaacacggc caccctgacc atcagcaggg tcgaagccgg ggatgaggcc  660
gactattact gtcaggtgtg ggatagtagt agtgatcatg tggtattcgg cggagggacc  720
aagctgaccg tcctaggt                                                738

SC06-339 amino acid sequence
                                                       (SEQ ID NO: 400)
EVQLVESGAEVKKPGSSVKVSCKASGGIFNSYAISWVRQAPGQGLEWMGGIIAIFHTPKYAQ

KFQGRVTITADESTNTAYMELRSLKSEDTALYYCARGSTYDFSSGLDYWGQGTLVTVSSGTG

GSGGTGSGTGGSTQAGLTQPPSVSVAPGQTARITCGGNNIGSKSVHWYQQKPGQAPVLVVY

DDSDRPSGIPERFSGSNSGNTATLTISRVEAGDEADYYCQVWDSSSDHVVFGGGTKLTVLG

SC06-339 VH amino acid sequence
                                                       (SEQ ID NO: 397)
EVQLVESGAEVKKPGSSVKVSCKASGGIFNSYAISWVRQAPGQGLEWMGGIIAIFHTPKYA

QKFQGRVTITADESTNTAYMELRSLKSEDTALYYCARGSTYDFSSGLDYWGQGTLVTVSS

SC06-339 VL amino acid sequence
                                                       (SEQ ID NO: 398)
QAGLTQPPSVSVAPGQTARITCGGNNIGSKSVHWYQQKPGQAPVLVVYDDSDRPSGIPERFS

GSNSGNTATLTISRVEAGDEADYYCQVWDSSSDHVVFGGGTKLTVLG
```

The SC06-342 HA-specific single-chain Fv antibody includes a heavy chain variable region (SEQ ID NO: 401) and a light chain variable region (SEQ ID NO: 402) encoded by the nucleic acid sequence shown in SEQ ID NO: 403 and the amino acid sequence shown in SEQ ID NO: 404. The VH-locus is VH1 (1-69) and the VL locus is VKIV (B3).

The amino acids encompassing the CDRs are highlighted in bold in the sequences below. The heavy chain CDRs of the SC06-342 antibody have the following CDR sequences: SYAIS (HCDR1, SEQ ID NO: 251), GVIPIFRTANYAQNFQG (HCDR2, SEQ ID NO: 249) and LNYHDSGTYYNAPRGWFDP (HCDR3, SEQ ID NO: 246). The light chain CDRs of the SC06-342 antibody have the following CDR sequences: KSSQSILNSSNNKNYLA (LCDR1, SEQ ID NO: 245), WASTRES (LCDR2, SEQ ID NO: 570) and QQYYSSPPT (LCDR3, SEQ ID NO: 250).

```
SC06-342 nucleotide sequence
                                                     (SEQ ID NO: 403)
caggtccagc tggtgcagtc tggggctgag gtgaagaagc ctgggtcctc ggtgaaggtc    60
tcctgcaagg cttctggagg cttcttcagc agctatgcta tcagctgggt gcgccaggcc   120
cctggacaag gacttgagtg gatggggggg gtcatcccta tctttcgtac agcaaactac   180
gcacagaact ccagggcag agtcaccatt accgcggacg aattcacatc gtatatggag   240
ctgagcagcc tgagatctga cgacacggcc gtgtattact gtgcgaggtt gaattaccat   300
gattcgggga cttattataa cgccccccgg ggctggttcg acccctgggg ccagggaacc   360
ctggtcaccg tctcgagcgg tacgggcggt tcaggcggaa ccgcagcgg cactggcggg   420 tcgacggaca tccagatgac ccagtctcca gactccctgg ctgtgtctct gggcgagaag   480
gccaccatca actgcaagtc cagccagagt attttaaaca gctccaacaa taagaactac   540
ttagcttggt accagcagaa accaggacag cctcctaagc tgctcattta ctgggcatct   600
acccgggaat ccggggtccc tgaccgattc agtggcagcg ggtctgggac agatttcact   660
ctcaccatca gcagcctgca ggctgaagat gtggcagttt attactgtca gcaatattat   720
agtagtccgc cgacgttcgg ccaagggacc aaggtggaaa tcaaacgt              768

SC06-342 amino acid sequence
                                                     (SEQ ID NO: 404)
QVQLVQSGAEVKKPGSSVKVSCKASGGFFSSYAISWVRQAPGQGLEWMGGVIPIFRTANYA

QNFQGRVTITADEFTSYMELSSLRSDDTAVYYCARLNYHDSGTYYNAPRGWFDPWGQGTLV

TVSSGTGGSGGTGSGTGGSTDIQMTQSPDSLAVSLGEKATINCKSSQSILNSSNNKNYLAWYQ

QKPGQPPKLIAYWASTRESGVPDRFSGSGSGTDFTLTISSLQAEDVAVYYCQQYYSSPPTFGQ

GTKVEIKR

SC06-342 VH amino acid sequence
                                                     (SEQ ID NO: 401)
QVQLVQSGAEVKKPGSSVKVSCKASGGFFSSYAISWVRQAPGQGLEWMGGVIPIFRTANYA

QNFQGRVTITADEFTSYMELSSLRSDDTAVYYCARLNYHDSGTYYNAPRGWFDPWGQGT

LVTVSS

SC06-342 VL amino acid sequence
                                                     (SEQ ID NO: 402)
DIQMTQSPDSLAVSLGEKATINCKSSQSILNSSNNKNYLAWYQQKPGQPPKLLIYWASTRES

GVPDRFSGSGSGTDFTLTISSLQAEDVAVYYCQQYYSSPPTFGQGTKVEIKR
```

The SC06-343 HA-specific single-chain Fv antibody includes a heavy chain variable region (SEQ ID NO: 405) and a light chain variable region (SEQ ID NO: 406) encoded by the nucleic acid sequence shown in SEQ ID NO: 407 and the amino acid sequence shown in SEQ ID NO: 408. The VH-locus is VH1 (1-69) and the VL locus is VL3 (V2-14).

The amino acids encompassing the CDRs are highlighted in bold in the sequences below. The heavy chain CDRs of the SC06-343 antibody have the following CDR sequences: YYAMS (HCDR1, SEQ ID NO: 242), GISPMFGTT-TYAQKFQG (HCDR2, SEQ ID NO: 307) and SSNYYDS-VYDY (HCDR3, SEQ ID NO: 290). The light chain CDRs of the SC06-343 antibody have the following CDR sequences: GGHNIGSNSVH (LCDR1, SEQ ID NO: 224), DNSDRPS (LCDR2, SEQ ID NO: 223) and QVWGSSSDH (LCDR3, SEQ ID NO: 227).

```
SC06-343 nucleotide sequence
                                                     (SEQ ID NO: 407)
caggtccagc tggtgcagtc tggagctgag gtgaagaagc ctgggtcctc ggtgaaggtc    60
tcctgcaagg cttctggagt caccttcagt tactatgcta tgagctgggt gcgacaggcc   120
cctggacaag gcttgagtg gatgggagga atcagcccta tgtttgggac aacaacctac   180
gcacagaagt tccagggcag agtcacgatt actgcggacg actccacgag tacagcctac   240
atggaggtga ggagcctgag atctgaggac acggccgtgt attactgtgc gagatcttcg   300
aattactatg atagtgtata tgactactgg ggccagggaa ccctggtcac cgtctcgagc   360
ggtacgggcg gttcaggcgg aaccggcagc ggcactggcg ggtcgacgca gtctgtcgtg   420
acgcagccgc cctcggagtc agtggcccca ggacagacgg ccaggattac ctgtggggga   480
cataacattg gaagtaatag tgtgcactgg taccagcaga agccaggcca ggcccctgtg   540
ctggtcgtgt atgataatag cgaccggccc tcagggatcc ctgagcgatt ctctggctcc   600
aactctggga acacggccac cctgaccatc agcagggtcg aagccgggga tgaggccgac   660
tattactgtc aggtgtgggg tagtagtagt gaccattatg tcttcggaac tgggaccaag   720
gtcaccgtcc taggt                                                    735

SC06-343 amino acid sequence
                                                     (SEQ ID NO: 408)
QVQLVQSGAEVKKPGSSVKVSCKASGVTFSYYAMSWVRQAPGQGLEWMGGISPMFGTTTY

AQKFQGRVTITADDSTSTAYMEVRSLRSEDTAVYYCARSSNYYDSVYDYWGQGTLVTVSSG

TGGSGGTGSGTGGSTQSVVTQPPSESVAPGQTARITCGGHNIGSNSVHWYQQKPGQAPVLVV

YDNSDRPSGIPERFSGSNSGNTATLTISRVEAGDEADYYCQVWGSSSDHYVFGTGTKVTVLG

SC06-343 VH amino acid sequence
                                                     (SEQ ID NO: 405)
QVQLVQSGAEVKKPGSSVKVSCKASGVTFSYYAMSWVRQAPGQGLEWMG**GISPMFGTTT

YAQKFQGRVTITADDSTSTAYMEVRSLRSEDTAVYYCARSSNYYDSVYDY**WGQGTLVTVSS

SC06-343 VL amino acid sequence
                                                     (SEQ ID NO: 406)
QSVVTQPPSESVAPGQTARITCGGHNIGSNSVHWYQQKPGQAPVLVVYDNSDRPSGIPERFS

GSNSGNTATLTISRVEAGDEADYYCQVWGSSSDHYVFGTGTKVTVLG
```

The SC06-344 HA-specific single-chain Fv antibody includes a heavy chain variable region (SEQ ID NO: 409) and a light chain variable region (SEQ ID NO: 410) encoded by the nucleic acid sequence shown in SEQ ID NO: 411 and the amino acid sequence shown in SEQ ID NO: 412. The VH-locus is VH1 (1-69) and the VL locus is VL1 (V1-13).

The amino acids encompassing the CDRs are highlighted in bold in the sequences below. The heavy chain CDRs of the SC06-344 antibody have the following CDR sequences: NYAMS (HCDR1, SEQ ID NO: 222), GIIAIFGTPKYAQK-FQG (HCDR2, SEQ ID NO: 221) and IPHYNFGSGSYFDY (HCDR3, SEQ ID NO: 220). The light chain CDRs of the SC06-344 antibody have the following CDR sequences: TGSSSNIGAGYDVH (LCDR1, SEQ ID NO: 219), GNSNRPS (LCDR2, SEQ ID NO: 231) and GTWDSSLSAYV (LCDR3, SEQ ID NO: 280).

```
SC06-344 nucleotide sequence
                                                      (SEQ ID NO: 411)
caggtgcagc tggtgcagtc tggggctgag gtgaagaagc ctgggtcctc ggtgagagtc   60
tcctgcaagg cttctggaag catcttcaga aactatgcta tgagctgggt gcgacaggcc  120
cctggacaag ggcttgagtg gatgggaggg atcatcgcta tttttgggac accaaagtac  180
gcacagaagt tccagggcag agtcacgatt accgcggacg aatcgacgag cactgtctac  240
atggaactga gcggactgag atctgaggac acggccatgt attactgtgc gaggattccc  300
cactataatt ttggttcggg gagttatttc gactactggg gccagggaac cctggtcacc  360
gtctcgagcg gtacgggcgg ttcaggcgga accggcagcg gcactggcgg gtcgacgact  420
gtgttgacac agccgccctc agtgtctggg gccccagggc agagggtcac catctcctgc  480
actgggagca gctccaacat cgggggcaggt tatgatgtac actggtacca gcagcttcca  540
ggaacagccc ccaaactcct catctatggt aacagcaatc ggccctcagg ggtccctgac  600
cgattctctg gctccaagtc tggcacgtca gccaccctgg gcatcaccgg actccagact  660
ggggacgagg ccgattatta ctgcggaaca tgggatagca gcctgagtgc ttatgtcttc  720
ggaactggga ccaaggtcac cgtcctaggt                                    750

SC06-344 amino acid sequence
                                                      (SEQ ID NO: 412)
QVQLVQSGAEVKKPGSSVRVSCKASGSIFRNYAMSWVRQAPGQGLEWMGGIIAIFGTPKYA

QKFQGRVTITADESTSTVYMELSGLRSEDTAMYYCARIPHYNFGSGSYFDYWGQGTLVTVSS

GTGGSGGTGSGTGGSTTVLTQPPSVSGAPGQRVTISCTGSSSNIGAGYDVHWYQQLPGTAPK

LLIYGNSNRPSGVPDRFSGSKSGTSATLGITGLQTGDEADYYCGTWDSSLSAYVFGTGTKVT

VLG

SC06-344 VH amino acid sequence
                                                      (SEQ ID NO: 409)
QVQLVQSGAEVKKPGSSVRVSCKASGSIFRNYAMSWVRQAPGQGLEWMGGIIAIFGTPKY

AQKFQGRVTITADESTSTVYMELSGLRSEDTAMYYCARIPHYNFGSGSYFDYWGQGTLVT

VSS

SC06-344 VL amino acid sequence
                                                      (SEQ ID NO: 410)
TVLTQPPSVSGAPGQRVTISCTGSSSNIGAGYDVHWYQQLPGTAPKLLIYGNSNRPSGVPDR

FSGSKSGTSATLGITGLQTGDEADYYCGTWDSSLSAYVFGTGTKVTVLG
```

IgG HA Antibodies

The CR6141 HA-specific IgG antibody includes a heavy chain variable region (SEQ ID NO: 199) encoded by the heavy chain nucleotide sequence shown in SEQ ID NO: 279 and the heavy chain amino acid sequence shown in SEQ ID NO: 413. The CR6141 HA-specific IgG antibody also includes a light chain variable region (SEQ ID NO: 414) encoded by the light chain nucleotide sequence shown in SEQ ID NO: 415 and the light chain amino acid sequence shown in SEQ ID NO: 416.

```
CR6141 Heavy Chain nucleotide sequence
                                                         (SEQ ID NO: 279)
gaggtccagc tggtgcagtc tggggctgag gtgaagaagc ctggggcctc agtgaaggtc    60
tcctgcaagg cttctgggta caccttcacc ggctactatg tgtactgggt gcgacaggcc   120
cctggacaag gcttgagtg gatgggatgg atcagcgctt acaatggtaa cacaaactat    180
gcacagaagt tccagggcag agtcacgatt accgcggaca atccacgag cacagcctac    240 atggagctga gcagcctgag atctgaagac acggctgtgt attactgtgc gagaagtaga   300
tccctggacg tctggggcca agggaccacg gtcaccgtct cgagtgctag caccaagggc   360
cccagcgtgt tcccctggc cccagcagc aagagcacca gcggcggcac agccgccctg     420
ggctgcctgg tgaaggacta cttccccgag cccgtgaccg tgagctgaa cagcggcgcc    480 ttgaccagcg gcgtgcacac cttccccgcc gtgctgcaga gcagcggcct gtacagcctg   540
agcagcgtgg tgaccgtgcc agcagcagc ctgggcaccc agacctacat ctgcaacgtg    600
aaccacaagc ccagcaacac caaggtggac aaacgcgtgg agcccaagag ctgcgacaag   660
acccacacct gccccccctg ccctgccccc gagctgctgg gcggaccctc cgtgttcctg   720
ttccccccca gcccaagga caccctcatg atcagccgga ccccccgaggt gacctgcgtg    780 gtggtggacg tgagccacga ggaccccgag gtgaagttca actggtacgt ggacggcgtg   840
gaggtgcaca cgccaagac caagcccgg gaggagcagt acaacagcac ctaccgggtg     900
gtgagcgtgc tcaccgtgct gcaccaggac tggctgaacg gcaaggagta caagtgcaag   960
gtgagcaaca aggccctgcc tgcccccatc gagaagacca tcagcaaggc caagggccag  1020 ccccggggagc cccaggtgta caccctgccc ccagccgggg aggagatgac caagaaccag  1080
gtgtccctca cctgtctggt gaagggcttc taccccagcg acatcgccgt ggagtgggag  1140
agcaacggcc agcccgagaa caactacaag accacccccc ctgtgctgga cagcgacggc  1200
agcttcttcc tgtacagcaa gctcaccgtg gacaagagcc ggtggcagca gggcaacgtg   1260
ttcagctgca gcgtgatgca cgaggccctg cacaaccact acacccagaa gagcctgagc  1320
ctgagccccg gcaag                                                  1335

CR6141 Heavy Chain amino acid sequence
                                                         (SEQ ID NO: 413)
EVQLVQSGAEVKKPGASVKVSCKASGYTFTGYYVYWVRQAPGQGLEWMGWISAYNGNTN

YAQKFQGRVTITADKSTSTAYMELSSLRSEDTAVYYCARSRSLDVWGQGTTVTVSSASTKGP

SVFPLAPSSKSTSGGTAALGCLVKDYFPEPVTVSWNSGALTSGVHTFPAVLQSSGLYSLSSVV

TVPSSSLGTQTYICNVNHKPSNTKVDKRVEPKSCDKTHTCPPCPAPELLGGPSVFL

FPPKPKDTLMISRTPEVTCVVVDVSHEDPEVKFNWYVDGVEVHNAKTKPREEQYNSTYRV

VSVLTVLHQDWLNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLTVDKSRWQQGNV

FSCSVMHEALHNHYTQKSLSLSPGK

CR6141 VH amino acid sequence
                                                         (SEQ ID NO: 199)
EVQLVQSGAEVKKPGASVKVSCKASGYTFTGYYVYWVRQAPGQGLEWMGWISAYNGNTN

YAQKFQGRVTITADKSTSTAYMELSSLRSEDTAVYYCARSRSLDVWGQGTTVTVSS
```

CR6141 Light Chain nucleotide sequence
(SEQ ID NO: 415)

```
gatgttgtga tgactcagtc tccagactcc ctggctgtgt ctctgggcga gagggccacc    60
atcaactgca agtccagcca gagtgtttta tacagctcca acaataagaa ctacttagct   120
tggtaccagc agaaaccagg acagcctcct aagctgctca tttactgggc atctacccgg   180
gaatccgggg tccctgaccg attcagtggc agcgggtctg ggacagattt cactctcacc   240
atcagcagcc tgcaggctga agatgtggca gtttattact gtcagcaata ttatagtact   300
cctctcactt tcggcggagg gaccaaagtg gatatcaaac gtgcggccgc acccagcgtg   360
ttcatcttcc cccctccga cgagcagctg aagagcggca ccgccagcgt ggtgtgcctg   420
ctgaacaact ctacccccg ggaggccaag gtgcagtgga aggtggacaa cgccctgcag   480
agcggcaaca gccaggagag cgtgaccgag caggacagca aggactccac ctacagcctg   540
agcagcaccc tcaccctgag caaggccgac tacgagaagc acaaggtgta cgcctgcgag   600
gtgacccacc agggcctgag cagccccgtg accaagagct caaccggggg cgagtgt     657
```

CR6141 Light Chain amino acid sequence
(SEQ ID NO: 416)

DVVMTQSPDSLAVSLGERATINCKSSQSVLYSSNNKNYLAWYQQKPGQPPKLLIYWASTRES
GVPDRFSGSGSGTDFTLTISSLQAEDVAVYYCQQYYSTPLTFGGGTKVDIKRAAAPSVFIFPPS
DEQLKSGTASVVCLLNNFYPREAKVQWKVDNALQSGNSQESVTEQDSKDSTYSLSSTLTLSK
ADYEKHKVYACEVTHQGLSSPVTKSFNRGEC

CR6141 VL amino acid sequence
(SEQ ID NO: 414)

DVVMTQSPDSLAVSLGERATINCKSSQSVLYSSNNKNYLAWYQQKPGQPPKLLIYWASTRES
GVPDRFSGSGSGTDFTLTISSLQAEDVAVYYCQQYYSTPLTFGGGTKVDIKR

The CR6255 HA-specific IgG antibody includes a heavy chain variable region (SEQ ID NO: 417) encoded by the heavy chain nucleotide sequence shown in SEQ ID NO: 418 and the heavy chain amino acid sequence shown in SEQ ID NO: 419. The CR6255 HA-specific IgG antibody also includes a light chain variable region (SEQ ID NO: 420) encoded by the light chain nucleotide sequence shown in SEQ ID NO: 421 and the light chain amino acid sequence shown in SEQ ID NO: 422.

CR6255 Heavy Chain nucleotide sequence
(SEQ ID NO: 418)

```
gaggtgcagc tggtggagtc tggggctgag gtgaagaagc ctgggtcctc ggtgaaagtc    60
tcttgcaagg cttctggagg ccccttccgc agctatgcta tcagctgggt gcgacaggcc   120
cctggacaag ggcctgagtg gatgggaggg atcatcccta tttttggtac aacaaaatac   180
gcaccgaagt tccagggcag agtcacgatt accgcggacg atttcgcggg cacagtttac   240
atggagctga gcagcctgcg atctgaggac acggccatgt actactgtgc gaaacatatg   300
gggtaccagg tgcgcgaaac tatggacgtc tggggcaaag gaccacggt caccgtctcg   360
agtgctagca ccaagggccc cagcgtgttc cccctggccc ccagcagcaa gagcaccagc   420
ggcggcacag ccgccctggg ctgcctggtg aaggactact cccccgagcc cgtgaccgtg   480
agctggaaca gcggcgcctt gaccagcggc gtgcacacct cccccgccgt gctgcagagc   540
agcggcctgt acagcctgag cagcgtggtg accgtgccca gcagcagcct gggcacccag   600
acctacatct gcaacgtgaa ccacaagccc agcaacacca aggtggacaa gcgcgtggag   660
cccaagagct gcgacaagac ccacacctgc cccccctgcc ctgccccga gctgctgggc   720
ggaccctccg tgttcctgtt cccccccaag cccaaggaca cctcatgat cagccggacc   780
cccgaggtga cctgcgtggt ggtggacgtg agccacgagg accccgaggt gaagttcaac   840
tggtacgtgg acggcgtgga ggtgcacaac gccaagacca gccccggga ggagcagtac   900
```

```
aacagcacct accgggtggt gagcgtgctc accgtgctgc accaggactg gctgaacggc    960
aaggagtaca agtgcaaggt gagcaacaag gccctgcctg cccccatcga aagaccatc    1020 agcaaggcca agggccagcc ccgggagccc caggtgtaca ccctgccccc agccgggag    1080 gagatgacca agaaccaggt gtccctcacc tgtctggtga agggcttcta ccccagcgac    1140
atcgccgtgg agtgggagag caacggccag ccgagaaca actacaagac cacccccct    1200 gtgctggaca cgacggcag cttcttcctg tacagcaagc tcaccgtgga caagagccgg    1260
tggcagcagg gcaacgtgtt cagctgcagc gtgatgcacg aggccctgca caaccactac    1320
acccagaaga gcctgagcct gagccccggc aag                                 1353
```

CR6255 Heavy Chain amino acid sequence
(SEQ ID NO: 419)
EVQLVESGAEVKKPGSSVKVSCKASGGPFRSYAISWVRQAPGQGPEWMGGIIPIFGTTKYAP

KFQGRVTITADDFAGTVYMELSSLRSEDTAMYYCAKHMGYQVRETMDVWGKGTTVTVSSA

STKGPSVFPLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDKTHTCPPCPAPELLG

GPSVFLFPPKPKDTLMISRTPEVTCVVVDVSHEDPEVKFNWYVDGVEVHNAKTKPREEQY

NSTYRVVSVLTVLHQDWLNGKEYKCKVSNKALPAPIEKTISKAKGQPREPQVYTLPPSRE

EMTKNQVSLTCLVKGFYPSDIAVEWESNGQPENNYKTTPPVLDSDGSFFLYSKLTVDKSR

WQQGNVFSCSVMHEALHNHYTQKSLSLSPGK

CR6255 VH amino acid sequence
(SEQ ID NO: 417)
EVQLVESGAEVKKPGSSVKVSCKASGGPFRSYAISWVRQAPGQGPEWMGGIIPIFGTTKY

APKFQGRVTITADDFAGTVYMELSSLRSEDTAMYYCAKHMGYQVRETMDVWGKGTTVTVSS

CR6255 Light Chain nucleotide sequence
(SEQ ID NO: 421)
```
tcctatgtgc tgactcagcc acccctcagcg tctgggaccc ccgggcagag ggtcaccatc    60
tcttgttctg gaagcacgtt caacatcgga agtaatgctg tagactggta ccggcagctc    120
ccaggaacgg cccccaaact cctcatctat agtaataatc agcggccctc aggggtccct    180
gaccgattct ctggctccag gtctggcacc tcagcctccc tggccatcag tgggctccag    240
tctgaggatg aggctgatta ttactgtgca gcatgggatg acatcctgaa tgttccggta    300
ttcggcggag ggaccaagct gaccgtccta ggtgcggccg caggccagcc caaggccgct    360
cccagcgtga ccctgttccc cccctcctcc gaggagctgc aggccaacaa ggccaccctg    420
gtgtgcctca tcagcgactt ctaccctggc gccgtgaccg tggcctggaa ggccgacagc    480
agccccgtga aggccggcgt ggagaccacc acccccagca gcagagcaa caacaagtac    540 gccgccagca gctacctgag cctcacccccc agcagtggga gagccaccg agctacagc    600 tgccaggtga cccacgaggg cagcaccgtg gagaagaccg tggcccccac cgagtgcagc    660
```

CR6255 Light Chain amino acid sequence
(SEQ ID NO: 422)
SYVLTQPPSASGTPGQRVTISCSGSTFNIGSNAVDWYRQLPGTAPKLLIYSNNQRPSGVPDRFS

GSRSGTSASLAISGLQSEDEADYYCAAWDDILNVPVFGGGTKLTVLGAAAGQPKAAPSVTLF

PPSSEELQANKATLVCLISDFYPGAVTVAWKADSSPVKAGVETTTPSKQSNNKYAASSYLSL

TPEQWKSHRSYSCQVTHEGSTVEKTVAPTECS

CR6255 VL amino acid sequence
(SEQ ID NO: 420)
SYVLTQPPSASGTPGQRVTISCSGSTFNIGSNAVDWYRQLPGTAPKLLIYSNNQRPSGVPDRFS

GSRSGTSASLAISGLQSEDEADYYCAAWDDILNVPVFGGGTKLTVLG

The CR6257 HA-specific IgG antibody includes a heavy chain variable region (SEQ ID NO: 423) encoded by the heavy chain nucleotide sequence shown in SEQ ID NO: 424 and the heavy chain amino acid sequence shown in SEQ ID NO: 425. The CR6257 HA-specific IgG antibody also includes a light chain variable region (SEQ ID NO: 426) encoded by the light chain nucleotide sequence shown in SEQ ID NO: 427 and the light chain amino acid sequence shown in SEQ ID NO: 428.

```
CR6257 Heavy Chain nucleotide sequence
                                                      (SEQ ID NO: 424)
caggtccagc tggtgcagtc tggggctgag gtgaagaagc ctgggtcctc ggtgaaagtc    60
tcttgcaagg cttctggagg ccccttccgc agctatgcta tcagctgggt gcgacaggcc   120
cctggacaag gccctgagtg gatgggaggg atcatccctt tttttggtac aacaaaatac   180
gcaccgaagt tccagggcag agtcacgatt accgcggacg atttcgcggg cacagtttac   240
atggagctga gcagcctgcg atctgaggac acggccatgt actactgtgc gaaacatatg   300
gggtaccagg tgcgcgaaac tatgacgtc tggggcaaag gaccacggt caccgtctcg   360 agtgctagca ccaagggccc cagcgtgttc ccctggccc ccagcagcaa gagcaccagc   420
ggcggcacag ccgccctggg ctgcctggtg aaggactact ccccgagcc cgtgaccgtg   480 agctggaaca gcggcgcctt gaccagcggc gtgcacacct ccccgccgt gctgcagagc   540 agcggcctgt acagcctgag cagcgtggtg accgtgccca gcagcagcct gggcacccag   600
acctacatct gcaacgtgaa ccacaagccc agcaacacca aggtggacaa acgcgtggag   660
cccaagagct gcgacaagac ccacacctgc ccccctgcc ctgcccccga gctgctgggc   720
ggaccctccg tgttcctgtt cccccccaag cccaaggaca ccctcatgat cagccggacc   780
cccgaggtga cctgcgtggt ggtggacgtg agccacgagg accccgaggt gaagttcaac   840
tggtacgtgg acggcgtgga ggtgcacaac gccaagacca gccccgggga ggagcagtac   900
aacagcacct accgggtggt gagcgtgctc accgtgctgc accaggactg gctgaacggc   960
aaggagtaca gtgcaaggt gagcaacaag gccctgcctg cccccatcga aagaccatc   1020 agcaaggcca agggccagcc ccgggagccc caggtgtaca ccctgccccc cagccgggag   1080
gagatgacca gaaccaggt gtccctcacc tgtctggtga agggcttcta ccccagcgac   1140
atcgccgtgg agtgggagag caacggccag cccgagaaca actacaagac cacccccct   1200 gtgctggaca cgacggcag cttcttcctg tacagcaagc tcaccgtgga caagagccgg   1260
tggcagcagg gcaacgtgtt cagctgcagc gtgatgcacg aggccctgca caaccactac   1320
acccagaaga gcctgagcct gagccccggc aag                                1353

CR6257 Heavy Chain amino acid sequence
                                                      (SEQ ID NO: 425)
QVQLVQSGAEVKKPGSSVKVSCKASGGPFRSYAISWVRQAPGQGPEWMGGIIPIFGTTKY

APKFQGRVTITADDFAGTVYMELSSLRSEDTAMYYCAKHMGYQVRETMDVWGKGTTVTVS

SASTKGPSVFPLAPSSKSTSGGTAALGCLVKDYFPEPVTVSWNSGALTSGVHTFPAVLQSSGL

YSLSSVVTVPSSSLGTQTYICNVNHKPSNTKVDKRVEPKSCDKTHTCPPCPAPELLGGPSVFLF

PPKPKDTLMISRTPEVTCVVVDVSHEDPEVKFNWYVDGVEVHNAKTKPREEQY

NSTYRVVSVLTVLHQDWLNGKEYKCKVSNKALPAPIEKTISKAKGQPREPQVYTLPPSRE

EMTKNQVSLTCLVKGFYPSDIAVEWESNGQPENNYKTTPPVLDSDGSFFLYSKLTVDKSR

WQQGNVFSCSVMHEALHNHYTQKSLSLSPGK

CR6257 VH amino acid sequence
                                                      (SEQ ID NO: 423)
QVQLVQSGAEVKKPGSSVKVSCKASGGPFRSYAISWVRQAPGQGPEWMGGIIPIFGTTKY

APKFQGRVTITADDFAGTVYMELSSLRSEDTAMYYCAKHMGYQVRETMDVWGKGTTVTVSS
```

```
CR6257 Light Chain nucleotide sequence
                                                          (SEQ ID NO: 427)
cagtctgccc tgactcagcc tgccgccgtg tctgggtctc ctggacagtc gatcaccatc    60
tcctgcactg gaaccagcag tgacgttggt ggttataact atgtctcctg gtaccaacag   120
cacccaggca aagcccccaa actcatgatt tatgaggtca gtaatcggcc ctcaggggtt   180
tctaatcgct tctctggctc caagtctggc aacacggcct ccctgaccat ctctgggctc   240
caggctgagg acgaggctga ttattactgc agctcatata agcagcag cacttatgtc     300 ttcggaactg ggaccaaggt caccgtccta ggtgcggccg caggccagcc caaggccgct   360
cccagcgtga ccctgttccc cccctcctcc gaggagctgc aggccaacaa ggccaccctg   420
gtgtgcctca tcagcgactt ctaccctggc gccgtgaccg tggcctggaa ggccgacagc   480
agccccgtga aggccggcgt ggagaccacc accccagca agcagagcaa caacaagtac   540
gccgccagca gctacctgag cctcaccccc gagcagtgga agagccaccg gagctacagc   600
tgccaggtga cccacgaggg cagcaccgtg gagaagaccg tggcccccac cgagtgcagc   660

CR6257 Light Chain amino acid sequence
                                                          (SEQ ID NO: 428)
QSALTQPAAVSGSPGQSITISCTGTSSDVGGYNYVSWYQQHPGKAPKLMIYEVSNRPSGVSN

RFSGSKSGNTASLTISGLQAEDEADYYCSSYTSSSTYVFGTGTKVTVLGAAAGQPKAAPSVTL

FPPSSEELQANKATLVCLISDFYPGAVTVAWKADSSPVKAGVETTTPSKQSNNKYAASSYLSL

TPEQWKSHRSYS CQVTHEGSTVEKTVAPTECS

CR6257 VL amino acid sequence
                                                          (SEQ ID NO: 426)
QSALTQPAAVSGSPGQSITISCTGTSSDVGGYNYVSWYQQHPGKAPKLMIYEVSNRPSGVSN

RFSGSKSGNTASLTISGLQAEDEADYYCSSYTSSSTYVFGTGTKVTVLG
```

The CR6260 HA-specific IgG antibody includes a heavy chain variable region (SEQ ID NO: 429) encoded by the heavy chain nucleotide sequence shown in SEQ ID NO: 430 and the heavy chain amino acid sequence shown in SEQ ID NO: 431. The CR6260 HA-specific IgG antibody also includes a light chain variable region (SEQ ID NO: 432) encoded by the light chain nucleotide sequence shown in SEQ ID NO: 433 and the light chain amino acid sequence shown in SEQ ID NO: 434.

```
CR6260 Heavy Chain nucleotide sequence
                                                          (SEQ ID NO: 430)
gaggtgcagc tggtggagtc tgggggctgag gtgaagaagc ctgggtcctc ggtgaaagtc    60
tcttgcaagg cttctggagg ccccttccgc agctatgcta tcagctgggt gcgacaggcc   120
cctggacaag gcctgagtg gatgggaggg atcatcccta tttttggtac aacaaaatac   180
gcaccgaagt tccagggcag agtcacgatt accgcggacg atttcgcggg cacagtttac   240
atggagctga gcagcctgcg atctgaggac acggccatgt actactgtgc gaaacatatg   300
gggtaccagg tgcgcaaaac tatgacgtc tggggcaaag ggaccacggt caccgtctcg   360
agtgctagca ccaagggccc cagcgtgttc ccctggccc ccagcagcaa gagcaccagc     420
ggcggcacag ccgccctggg ctgcctggtg aaggactact cccccgagcc cgtgaccgtg   480
agctggaaca gcggcgccct gaccagcggc gtgcacacct ccccgccgt gctgcagagc    540 agcggcctgt acagcctgag cagcgtggtg accgtgccca gcagcagcct gggcacccag   600
acctacatct gcaacgtgaa ccacaagccc agcaacacca aggtggacaa gcgcgtggag   660
cccaagagct gcgacaagac ccacacctgc ccccctgcc ctgccccga gctgctgggc    720 ggaccctccg tgttcctgtt cccccccaag cccaaggaca ccctcatgat cagccggacc   780
cccgaggtga cctgcgtggt ggtggacgtg agccacgagg accccgaggt gaagttcaac   840
tggtacgtgg acggcgtgga ggtgcacaac gccaagacca gccccggga ggagcagtac   900
```

```
aacagcacct accgggtggt gagcgtgctc accgtgctgc accaggactg gctgaacggc      960
aaggagtaca agtgcaaggt gagcaacaag gccctgcctg ccccatcga aagaccatc      1020 agcaaggcca agggccagcc ccgggagccc caggtgtaca ccctgccccc agccgggag      1080 gagatgacca agaaccaggt gtccctcacc tgtctggtga agggcttcta ccccagcgac      1140
atcgccgtgg agtgggagag caacggccag ccgagaaca actacaagac cacccccct      1200 gtgctggaca cgacggcag cttcttcctg tacagcaagc tcaccgtgga caagagccgg      1260
tggcagcagg gcaacgtgtt cagctgcagc gtgatgcacg aggccctgca caaccactac      1320
acccagaaga gcctgagcct gagccccggc aag                                  1353
```

CR6260 Heavy Chain amino acid sequence
(SEQ ID NO: 431)
EVQLVESGAEVKKPGSSVKVSCKASGGPFRSYAISWVRQAPGQGPEWMGGIIPIFGTTKYAP

KFQGRVTITADDFAGTVYMELSSLRSEDTAMYYCAKHMGYQVRETMDVWGKGTTVTVSSA

STKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRWQQGNVFSCSVMH

EALHNHYTQKSLSLSPGK

CR6260 VH amino acid sequence
(SEQ ID NO: 429)
EVQLVESGAEVKKPGSSVKVSCKASGGPFRSYAISWVRQAPGQGPEWMGGIIPIFGTTKYAP

KFQGRVTITADDFAGTVYMELSSLRSEDTAMYYCAKHMGYQVRETMDVWGKGTTVTVSS

CR6260 Light Chain nucleotide sequence
(SEQ ID NO: 433)
```
tcctatgtgc tgactcagcc acccctcagtc tctgggaccc ccgggcagag ggtcaccatc       60
tcttgctctg gaagccgctc caacgtcgga gataattctg tatattggta tcaacacgtc      120
ccagaaatgg cccccaaact cctcgtctat aagaatactc aacggccctc aggagtccct      180
gcccggtttt ccggctccaa gtctggcact tcagcctccc tggccatcat tggcctccag      240
tccggcgatg aggctgatta ttattgtgtg gcatgggatg acagcgtaga tggctatgtc      300
ttcggatctg ggaccaaggt caccgtccta ggtgcggccg caggccagcc caaggccgct      360
cccagcgtga ccctgttccc cccctcctcc gaggagctgc aggccaacaa ggccaccctg      420
gtgtgcctca tcagcgactt ctaccctggc gccgtgaccg tggcctggaa ggccgacagc      480
agccccgtga aggccggcgt ggagaccacc acccccagca gcagagcaa caacaagtac      540 gccgccagca gctacctgag cctcacccc gagcagtgga gagccaccg gagctacagc      600 tgccaggtga cccacgaggg cagcaccgtg gagaagaccg tggccccac cgagtgcagc      660
```

CR6260 Light Chain amino acid sequence
(SEQ ID NO: 434)
SYVLTQPPSVSGTPGQRVTISCSGSRSNVGDNSVYWYQHVPEMAPKLLVYKNTQRPSGVP

ARFSGSKSGTSASLAIIGLQSGDEADYYCVAWDDSVDGYVFGSGTKVTVLGAAAGQPKAAP

SVTLFPPSSEELQANKATLVCLISDFYPGAVTVAWKADSSPVKAGVETTTPSKQSNNKY

AASSYLSLTPEQWKSHRSYSCQVTHEGSTVEKTVAPTECS

CR6260 VL amino acid sequence
(SEQ ID NO: 432)
SYVLTQPPSVSGTPGQRVTISCSGSRSNVGDNSVYWYQHVPEMAPKLLVYKNTQRPSGVP

ARFSGSKSGTSASLAIIGLQSGDEADYYCVAWDDSVDGYVFGSGTKVTVLG

The CR6261 HA-specific IgG antibody includes a heavy chain variable region (SEQ ID NO: 435) encoded by the heavy chain nucleotide sequence shown in SEQ ID NO: 436 and the heavy chain amino acid sequence shown in SEQ ID NO: 437. The CR6261 HA-specific IgG antibody also includes a light chain variable region (SEQ ID NO: 438) encoded by the light chain nucleotide sequence shown in SEQ ID NO: 439 and the light chain amino acid sequence shown in SEQ ID NO: 440.

```
CR6261 Heavy Chain nucleotide sequence
                                                        (SEQ ID NO: 436)
gaggtgcagc tggtggagtc tggggctgag gtgaagaagc ctgggtcctc ggtgaaagtc      60
tcttgcaagg cttctggagg ccccttccgc agctatgcta tcagctgggt gcgacaggcc     120
cctggacaag ggcctgagtg gatgggaggg atcatcccta tttttggtac aacaaaatac     180
gcaccgaagt tccagggcag agtcacgatt accgcggacg atttcgcggg cacagtttac     240
atggagctga gcagcctgcg atctgaggac acggccatgt actactgtgc gaaacatatg     300
gggtaccagg tgcgcgaaac tatgacgtc tggggcaaag gaccacggt caccgtctcg       360 agtgctagca ccaagggccc cagcgtgttc ccctggccc ccagcagcaa gagcaccagc      420
ggcggcacag ccgccctggg ctgcctggtg aaggactact cccccgagcc cgtgaccgtg     480
agctggaaca gcggcgcctt gaccagcggc gtgcacacct ccccgccgt gctgcagagc      540 agcggcctgt acagcctgag cagcgtggtg accgtgccca gcagcagcct gggcacccag     600
acctacatct gcaacgtgaa ccacaagccc agcaacacca aggtggacaa gcgcgtggag     660
cccaagagct gcgacaagac ccacacctgc ccccctgcc ctgccccga gctgctgggc       720 ggaccctccg tgttcctgtt cccccccaag cccaaggaca ccctcatgat cagccggacc     780
cccgaggtga cctgcgtggt ggtggacgtg agccacgagg accccgaggt gaagttcaac     840
tggtacgtgg acggcgtgga ggtgcacaac gccaagacca gccccgggga ggagcagtac     900
aacagcacct accgggtggt gagcgtgctc accgtgctgc accaggactg gctgaacggc     960
aaggagtaca gtgcaaggt gagcaacaag gccctgcctg cccccatcga aagaccatc     1020 agcaaggcca agggccagcc ccgggagccc caggtgtaca ccctgccccc cagccgggag    1080
gagatgacca gaaccaggt gtccctcacc tgtctggtga agggcttcta ccccagcgac    1140
atcgccgtgg agtgggagag caacggccag cccgagaaca actacaagac caccccccct   1200
gtgctggaca gcgacggcag cttcttcctg tacagcaagc tcaccgtgga caagagccgg    1260
tggcagcagg gcaacgtgtt cagctgcagc gtgatgcacg aggccctgca caaccactac    1320
acccagaaga gcctgagcct gagccccggc aag                                 1353

CR6261 Heavy Chain amino acid sequence
                                                        (SEQ ID NO: 437)
EVQLVESGAEVKKPGSSVKVSCKASGGPFRSYAISWVRQAPGQGPEWMGGIIPIFGTTKYAP

KFQGRVTITADDFAGTVYMELSSLRSEDTAMYYCAKHMGYQVRETMDVWGKGTTVTVSSA

STKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRWQQGNVFSCSVMH

EALHNHYTQKSLSLSPGK

CR6261 VH amino acid sequence
                                                        (SEQ ID NO: 435)
EVQLVESGAEVKKPGSSVKVSCKASGGPFRSYAISWVRQAPGQGPEWMGGIIPIFGTTKYAP

KFQGRVTITADDFAGTVYMELSSLRSEDTAMYYCAKHMGYQVRETMDVWGKGTTVTVSS
```

-continued

```
CR6261 Light Chain nucleotide sequence
                                              (SEQ ID NO: 439)
cagtctgtgt tgacgcagcc gccctcagtg tctgcggccc caggacagaa ggtcaccatc    60
tcctgctctg gaagcagctc caacattggg aatgattatg tatcctggta ccagcagctc   120
ccaggaacag cccccaaact cctcatttat gacaataata agcgaccctc agggattcct   180
gaccgattct ctggctccaa gtctggcacg tcagccaccc tgggcatcac cggactccag   240
actggggacg aggccaacta ttactgcgca acatgggatc gccgcccgac tgcttatgtt   300
gtcttcggcg agggaccaa gctgaccgtc ctaggtgcgg ccgcaggcca gcccaaggcc    360
gctcccagcg tgaccctgtt cccccctcc tccgaggagc tgcaggccaa caaggccacc    420
ctggtgtgcc tcatcagcga cttctaccct ggcgccgtga ccgtggcctg gaaggccgac   480
agcagccccg tgaaggccgg cgtggagacc accaccccca gcaagcagag caacaacaag   540
tacgccgcca gcagctacct gagcctcacc cccgagcagt ggaagagcca ccggagctac   600
agctgccagg tgacccacga gggcagcacc gtggagaaga ccgtggcccc caccgagtgc   660

CR6261 Light Chain amino acid sequence
                                              (SEQ ID NO: 440)
QSVLTQPPSVSAAPGQKVTISCSGSSSNIGNDYVSWYQQLPGTAPKLLIYDNNKRPSGIPDRFS

GSKSGTSATLGITGLQTGDEANYYCATWDRRPTAYVVFGGGTKLTVLGAAAGQPKAAPSVT

LFPPSSEELQANKATLVCLISDFYPGAVTVAWKADSSPVKAGVETTTPSKQSNNKYAASSYLS

LTPEQWKSHRSYSCQVTHEGSTVEKTVAPTECS

CR6261VL amino acid sequence
                                              (SEQ ID NO: 438)
QSVLTQPPSVSAAPGQKVTISCSGSSSNIGNDYVSWYQQLPGTAPKLLIYDNNKRPSGIPDRFS

GSKSGTSATLGITGLQTGDEANYYCATWDRRPTAYVVFGGGTKLTVLG
```

The CR6262 HA-specific IgG antibody includes a heavy chain variable region (SEQ ID NO: 441) encoded by the heavy chain nucleotide sequence shown in SEQ ID NO: 442 and the heavy chain amino acid sequence shown in SEQ ID NO: 443. The CR6262 HA-specific IgG antibody also includes a light chain variable region (SEQ ID NO: 444) encoded by the light chain nucleotide sequence shown in SEQ ID NO: 445 and the light chain amino acid sequence shown in SEQ ID NO: 446.

```
CR6262 Heavy Chain nucleotide sequence
                                              (SEQ ID NO: 442)
caggtacagc tgcagcagtc aggggctgag gtgaagaagc ctgggtcctc ggtgaaggtc    60
tcctgcaagg tttccggagt cattttcagc ggcagtgcga tcagctgggt gcgacaggcc   120
cctggacaag gccttgagtg gatgggaggg atcagccctc tctttggcac aacaaattac   180
gcacaaaagt tccagggcag agtcacgatt accgcggacc aatccacgaa cacaacctac   240
atggaggtga acagcctgag atatgaggac acggccgtgt atttctgtgc gcgaggtcca   300
aaatattaca gtgagtacat ggacgtctgg ggcaaaggga ccacggtcac cgtctcgagt   360
gctagcacca agggcccag cgtgttcccc ctggccccca gcagcaagag caccagcggc    420
ggcacagccg ccctgggctg cctggtgaag gactacttcc ccgagcccgt gaccgtgagc   480
tggaacagcg gcgccttgac cagcggcgtg cacaccttcc ccgccgtgct gcagagcagc   540
ggcctgtaca gcctgagcag cgtggtgacc gtgcccagca gcagcctggg cacccagacc   600
tacatctgca acgtgaacca caagcccagc aacaccaagg tggacaaacg cgtggagccc   660
aagagctgcg acaagaccca cacctgcccc cctgccctg ccccagct gctgggcgga     720 ccctccgtgt tcctgttccc cccaaagccc aaggacaccc tcatgatcag ccggacccc    780 gaggtgacct gcgtggtggt ggacgtgagc cacgaggacc ccgaggtgaa gttcaactgg   840
tacgtggacg gcgtggaggt gcacaacgcc aagaccaagc ccgggagga gcagtacaac    900
```

-continued

```
agcacctacc gggtggtgag cgtgctcacc gtgctgcacc aggactggct gaacggcaag    960
gagtacaagt gcaaggtgag caacaaggcc ctgcctgccc ccatcgagaa gaccatcagc   1020
aaggccaagg gccagccccg ggagcccag gtgtacaccc tgcccccag ccgggaggag    1080 atgaccaaga accaggtgtc cctcacctgt ctggtgaagg gcttctaccc cagcgacatc   1140
gccgtggagt gggagagcaa cggccagccc gagaacaact acaagaccac ccccctgtg    1200 ctggacagcg acggcagctt cttcctgtac agcaagctca ccgtggacaa gagccggtgg   1260
cagcagggca acgtgttcag ctgcagcgtg atgcacgagg ccctgcacaa ccactacacc   1320
cagaagagcc tgagcctgag ccccggcaag                                    1350
```

CR6262 Heavy Chain amino acid sequence
(SEQ ID NO: 443)
QVQLQQSGAEVKKPGSSVKVSCKVSGVIFSGSAISWVRQAPGQGLEWMGGISPLFGTTNYAQ

KFQGRVTITADQSTNTTYMEVNSLRYEDTAVYFCARGPKYYSEYMDVWGKGTTVTVSSAST

KGPSVFPLAPSSKSTSGGTAALGCLVKDYFPEPVTVSWNSGALTSGVHTFPAVLQSSGLYSLS

SVVTVPSSSLGTQTYICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYNSTYRVVSVLTV

LHQDWLNGKEYKCKVSNKALPAPIEKTISKAKGQPREPQVYTLPPSREEMTKNQVSLTCLVK

GFYPSDIAVEWESNGQPENNYKTTPPVLDSDGSFFLYSKLTVDKSRWQQGNVFSCSVMHEAL

HNHYTQKSLSLSPGK

CR6262 VH amino acid sequence
(SEQ ID NO: 441)
QVQLQQSGAEVKKPGSSVKVSCKVSGVIFSGSAISWVRQAPGQGLEWMGGISPLFGTTNYAQ

KFQGRVTITADQSTNTTYMEVNSLRYEDTAVYFCARGPKYYSEYMDVWGKGTTVTVSS

CR6262 Light Chain nucleotide sequence
(SEQ ID NO: 445)
```
gacatccaga tgacccagtc tccatcctcc ctgtctgcat ctgtaggaga cagagtcacc     60
atcacttgcc gggcgagtca gggcattagc agttatttag cctggtatca gcagaagcca    120
gggaaagttc ctacactcct gatctatgat gcatccactt tgcgatcagg ggtcccatct    180
cgcttcagtg gcagtggatc tgcgacagat ttcactctca ccatcagcag cctgcagcct    240
gaagatgttg caacttatta ctgtcaaagg tataacagtg ccccccccgat caccttcggc    300 caagggacac gactggagat taaacgtgcg gccgcaccca gcgtgttcat cttccccccc    360
tccgacgagc agctgaagag cggcaccgcc agcgtggtgt gcctgctgaa caacttctac    420 cccgggagg ccaaggtgca gtggaaggtg gacaacgccc tgcagagcgg caacagccag    480
gagagcgtga ccgagcagga cagcaaggac tccacctaca gcctgagcag caccctcacc    540
ctgagcaagg ccgactacga gaagcacaag gtgtacgcct gcgaggtgac ccaccagggc    600
ctgagcagcc ccgtgaccaa gagcttcaac cggggcgagt gt                      642
```

CR6262 Light Chain amino acid sequence
(SEQ ID NO: 446)
DIQMTQSPSSLSASVGDRVTITCRASQGISSYLAWYQQKPGKVPTLLIYDASTLRSGVPSRFSG

SGSATDFTLTISSLQPEDVATYYCQRYNSAPPITFGQGTRLEIKRAAAPSVFIFPPSDEQLKSGT

ASVVCLLNNFYPREAKVQWKVDNALQSGNSQESVTEQDSKDSTYSLSSTLTLSKADYEKHK

VYACEVTHQGLSSPVTKSFNRGEC

CR6262 VL amino acid sequence
(SEQ ID NO: 444)
DIQMTQSPSSLSASVGDRVTITCRASQGISSYLAWYQQKPGKVPTLLIYDASTLRSGVPSRFSG

SGSATDFTLTISSLQPEDVATYYCQRYNSAPPITFGQGTRLEIKR

The CR6268 HA-specific IgG antibody includes a heavy chain variable region (SEQ ID NO: 447) encoded by the heavy chain nucleotide sequence shown in SEQ ID NO: 448 and the heavy chain amino acid sequence shown in SEQ ID NO: 449. The CR6268 HA-specific IgG antibody also includes a light chain variable region (SEQ ID NO: 450) encoded by the light chain nucleotide sequence shown in SEQ ID NO: 451 and the light chain amino acid sequence shown in SEQ ID NO: 452.

```
CR6268 Heavy Chain nucleotide sequence
                                                        (SEQ ID NO: 448)
caggtccagc tggtacagtc tggggctgag gtgaagaagc ctgggtcctc ggtgaaggtc    60
tcctgcaagg cttctggagg caccttcagt agttatgcta tcagctgggt gcgacaggcc   120
cctggacaag gcttgagtg gatgggagga atcatgggta tgtttggcac aactaactac    180
gcacagaagt tccagggcag agtcacgatt accgcggacg aattcacgag cgcagcctac   240
atggagctga ggagcctgag atctgaggac acggccgtct actactgtgc gaggtctagt   300
ggttattacc ccgaatactt ccaggactgg ggcagggca ccctggtcac cgtctcgagt    360
gctagcacca agggcccag cgtgttcccc ctggccccca gcagcaagag caccagcggc    420
ggcacagccg ccctgggctg cctggtgaag gactacttcc ccgagcccgt gaccgtgagc   480
tggaacagcg gcgccttgac cagcggcgtg cacaccttcc ccgccgtgct gcagagcagc   540
ggcctgtaca gcctgagcag cgtggtgacc gtgcccagca gcagcctggg cacccagacc   600
tacatctgca acgtgaacca caagcccagc aacaccaagg tggacaaacg cgtggagccc   660
aagagctgcg acaagaccca cacctgcccc cctgccctg ccccgagct gctgggcgga    720 cctccgtgt tcctgttccc ccccaagccc aaggacaccc tcatgatcag ccggacccc    780 gaggtgacct gcgtggtggt ggacgtgagc cacgaggacc ccgaggtgaa gttcaactgg   840
tacgtggacg gcgtggaggt gcacaacgcc aagaccaagc ccgggagga gcagtacaac   900 agcacctacc gggtggtgag cgtgctcacc gtgctgcacc aggactggct gaacggcaag   960
gagtacaagt gcaaggtgag caacaaggcc ctgcctgccc ccatcgagaa gaccatcagc  1020
aaggccaagg gccagccccg ggagcccag gtgtacaccc tgccccccag ccgggaggag  1080
atgaccaaga accaggtgtc cctcacctgt ctggtgaagg gcttctaccc cagcgacatc  1140
gccgtggagt gggagagcaa cggccagccc gagaacaact acaagaccac cccccctgtg  1200
ctggacagcg acggcagctt cttcctgtac agcaagctca ccgtggacaa gagccggtgg  1260
cagcagggca acgtgttcag ctgcagcgtg atgcacgagg ccctgcacaa ccactacacc  1320
cagaagagcc tgagcctgag ccccggcaag                                   1350

CR6268 Heavy Chain amino acid sequence
                                                        (SEQ ID NO: 449)
QVQLVQSGAEVKKPGSSVKVSCKASGGTFSSYAISWVRQAPGQGLEWMGGIMGMFGTTNY

AQKFQGRVTITADEFTSAAYMELRSLRSEDTAVYYCARSSGYYPEYFQDWGQGTLVTVSSA

STKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRWQQGNVFSCSVMH

EALHNHYTQKSLSLSPGK

CR6268 VH amino acid sequence
                                                        (SEQ ID NO: 447)
QVQLVQSGAEVKKPGSSVKVSCKASGGTFSSYAISWVRQAPGQGLEWMGGIMGMFGTTNY

AQKFQGRVTITADEFTSAAYMELRSLRSEDTAVYYCARSSGYYPEYFQDWGQGTLVTVSS
```

-continued

```
CR6268 Light Chain nucleotide sequence
                                                      (SEQ ID NO: 451)
cagtctgtgc tgactcagcc accctcagag tccgtgtccc caggacagac agccagcgtc    60
acctgctctg gacataaatt gggggataaa tatgtttcgt ggtatcagca gaagccaggc   120
cagtcccctg tattactcat ctatcaagat aacaggcggc cctcagggat ccctgagcga   180
ttcataggct ccaactctgg gaacacagcc actctgacca tcagcgggac ccaggctctg   240
gatgaggctg actattactg tcaggcgtgg gacagcagca ctgcggtttt cggcggaggg   300
accaagctga ccgtcctagg tgcggccgca ggccagccca aggccgctcc cagcgtgacc   360
ctgttccccc cctcctccga ggagctgcag gccaacaagg ccaccctggt gtgcctcatc   420
agcgacttct accctggcgc cgtgaccgtg gcctggaagg ccgacagcag cccgtgaag    480 gccggcgtgg agaccaccac ccccagcaag cagagcaaca acaagtacgc cgccagcagc   540
tacctgagcc tcaccccga gcagtggaag agccaccgga gctacagctg ccaggtgacc   600
cacgagggca gcaccgtgga agaccgtg gcccccaccg agtgcagc                  648

CR6268 Light Chain amino acid sequence
                                                      (SEQ ID NO: 452)
QSVLTQPPSESVSPGQTASVTCSGHKLGDKYVSWYQQKPGQSPVLLIYQDNRRPSGIPERFIG

SNSGNTATLTISGTQALDEADYYCQAWDSSTAVFGGGTKLTVLGAAAGQPKAAPSVTLFPPS

SEELQANKATLVCLISDFYPGAVTVAWKADSSPVKAGVETTTPSKQSNNKYAASSYLSLTPE

QWKSHRSYSCQVTHEGSTVEKTVAPTECS

CR6268 VL amino acid sequence
                                                      (SEQ ID NO: 450)
QSVLTQPPSESVSPGQTASVTCSGHKLGDKYVSWYQQKPGQSPVLLIYQDNRRPSGIPERFIG

SNSGNTATLTISGTQALDEADYYCQAWDSSTAVFGGGTKLTVLG
```

The CR6272 HA-specific IgG antibody includes a heavy chain variable region (SEQ ID NO: 453) encoded by the heavy chain nucleotide sequence shown in SEQ ID NO: 454 and the heavy chain amino acid sequence shown in SEQ ID NO: 455. The CR6272 HA-specific IgG antibody also includes a light chain variable region (SEQ ID NO: 456) encoded by the light chain nucleotide sequence shown in SEQ ID NO: 457 and the light chain amino acid sequence shown in SEQ ID NO: 458.

```
CR6272 Heavy Chain nucleotide sequence
                                                      (SEQ ID NO: 454)
cagatgcagc tggtgcagtc tggggctgag gtgaagaagc ctgggtcctc ggtgaaggtc    60
tcctgcaagg cttctggagg caccttctcc agttatgcta tcacctgggt gcgacaggcc   120
cctggacaag gcttgagtg gatgggaggg atcatcggta tgtttggttc aacaaactac   180
gcacagaact tccagggcag agtcacgatt accgcggacg aatccacgag cacagcctac   240
atggagctga gcagcctcag atctgaggac acggccgtgt attactgtgc gagaagtact   300
ggttattacc ctgcatacct ccaccactgg ggccagggca ccctggtcac cgtctcgagt   360
gctagcacca agggcccag cgtgttcccc ctggccccca gcagcaagag caccagcggc   420
ggcacagccg ccctgggctg cctggtgaag gactacttcc ccgagcccgt gaccgtgagc   480
tggaacagcg gcgccttgac cagcggcgtg cacaccttcc cgcgtgct gcagagcagc    540 ggcctgtaca gctgagcag cgtggtgacc gtgcccagca gcagcctggg cacccagacc   600
tacatctgca acgtgaacca caagcccagc aacaccaagg tggacaaacg cgtggagccc   660
aagagctgcg acaagaccca cacctgcccc cctgccctg ccccgagct gctgggcgga   720 ccctcgtgt tcctgttccc cccaagccc aaggacaccc tcatgatcag ccggaccccc   780
gaggtgacct gcgtggtggt ggacgtgagc cacgaggacc ccgaggtgaa gttcaactgg   840
tacgtggacg gcgtggaggt gcacaacgcc aagaccaagc ccgggagga gcagtacaac   900
```

-continued

```
agcacctacc gggtggtgag cgtgctcacc gtgctgcacc aggactggct gaacggcaag    960
gagtacaagt gcaaggtgag caacaaggcc ctgcctgccc ccatcgagaa gaccatcagc   1020
aaggccaagg gccagccccg ggagcccag gtgtacaccc tgcccccag ccgggaggag    1080
atgaccaaga accaggtgtc cctcacctgt ctggtgaagg gcttctaccc cagcgacatc   1140
gccgtggagt gggagagcaa cggccagccc gagaacaact acaagaccac ccccctgtg    1200
ctggacagcg acggcagctt cttcctgtac agcaagctca ccgtggacaa gagccggtgg   1260
cagcagggca acgtgttcag ctgcagcgtg atgcacgagg ccctgcacaa ccactacacc   1320
cagaagagcc tgagcctgag ccccggcaag                                    1350
```

CR6272 Heavy Chain amino acid sequence
(SEQ ID NO: 455)
QMQLVQSGAEVKKPGSSVKVSCKASGGTFSSYAITWVRQAPGQGLEWMGGIIGMFGSTNYA

QNFQGRVTITADESTSTAYMELSSLRSEDTAVYYCARSTGYYPAYLHHWGQGTLVTVSSAST

KGPSVFPLAPSSKSTSGGTAALGCLVKDYFPEPVTVSWNSGALTSGVHTFPAVLQSSGLYSLS

SVVTVPSSSLGTQTYICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYNSTYRVVSVLTV

LHQDWLNGKEYKCKVSNKALPAPIEKTISKAKGQPREPQVYTLPPSREEMTKNQVSLTCLVK

GFYPSDIAVEWESNGQPENNYKTTPPVLDSDGSFFLYSKLTVDKSRWQQGNVFSCSVMHEAL

HNHYTQKSLSLSPGK

CR6272 VH amino acid sequence
(SEQ ID NO: 453)
QMQLVQSGAEVKKPGSSVKVSCKASGGTFSSYAITWVRQAPGQGLEWMGGIIGMFGSTNYA

QNFQGRVTITADESTSTAYMELSSLRSEDTAVYYCARSTGYYPAYLHHWGQGTLVTVSS

CR6272 Light Chain nucleotide sequence
(SEQ ID NO: 457)
```
cagtctgccc tgactcagcc tcgctcagtg tccgggtctc ctggacagtc agtcaccatc     60
tcctgcactg gaaccagcag tgatgttggt ggttataact atgtctcctg gtaccaacag    120
cacccaggca aagcccccaa actcatgatt tatgatgtca gtaagcggcc ctcaggggtc    180
cctgatcgct tctctggctc caagtctggc aacacggcct ccctgaccat ctctgggctc    240
caggctgagg atgaggctga ttattactgc agctcatata caagcagcag cactcatgtc    300
ttcggaactg ggaccaaggt caccgtccta ggtgcggccg caggccagcc caaggccgct    360
cccagcgtga ccctgttccc ccctcctcc gaggagctgc aggccaacaa ggccaccctg    420
gtgtgcctca tcagcgactt ctaccctggc gccgtgaccg tggcctggaa ggccgacagc    480
agccccgtga aggccggcgt ggagaccacc acccccagca gcagagcaa caacaagtac    540
gccgccagca gctacctgag cctcaccccc agcagtggaa gagccaccg gagctacagc    600
tgccaggtga cccacgaggg cagcaccgtg gagaagaccg tggcccccac cgagtgcagc    660
```

CR6272 Light Chain amino acid sequence
(SEQ ID NO: 458)
QSALTQPRSVSGSPGQSVTISCTGTSSDVGGYNYVSWYQQHPGKAPKLMIYDVSKRPSGVPD

RFSGSKSGNTASLTISGLQAEDEADYYCSSYTSSSTHVFGTGTKVTVLGAAAGQPKAAPSVTL

FPPSSEELQANKATLVCLISDFYPGAVTVAWKADSSPVKAGVETTTPSKQSNNKYAASSYLSL

TPEQWKSHRSYSCQVTHEGSTVEKTVAPTECS

CR6272 VL amino acid sequence
(SEQ ID NO: 456)
GSALTQPRSVSGSPGQSVTISCTGTSSDVGGYNYVSWYQQHPGKAPKLMIYDVSKRPSGVPD

RFSGSKSGNTASLTISGLQAEDEADYYCSSYTSSSTHVFGTGTKVTVLG

The CR696 HA-specific IgG antibody includes a heavy chain variable region (SEQ ID NO: 459) encoded by the heavy chain nucleotide sequence shown in SEQ ID NO: 460 and the heavy chain amino acid sequence shown in SEQ ID NO: 461. The CR6296 HA-specific IgG antibody also includes a light chain variable region (SEQ ID NO: 462) encoded by the light chain nucleotide sequence shown in SEQ ID NO: 463 and the light chain amino acid sequence shown in SEQ ID NO: 464.

```
CR6296 Heavy Chain nucleotide sequence
                                                       (SEQ ID NO: 460)
gaggtgcagc tggtggagac cggggctgag gtgaagaagc ctggggcctc agtgaaggtt     60
tcctgcaagg catctggata caccttcacc agctactata tgcactgggt gcgacaggcc    120
cctggacaag gcttgagtg gatgggatgg atcaaccta acagtggtgg cacaaactat     180
gcacagaagt tcagggcag ggtcaccatg accagggaca cgtccatcag cacagcctac    240
atggagctga gcaggctgag atctgacgac acggccgtgt attactgtgc gagagagggg    300
aaatggggac tcaagcggc ttttgatatc tggggccaag ggacaatggt caccgtctcg    360
agtgctagca ccaagggccc cagcgtgttc ccctggccc ccagcagcaa gagcaccagc    420
ggcggcacag ccgccctggg ctgcctggtg aaggactact cccccgagcc cgtgaccgtg    480
agctggaaca gcggcgcctt gaccagcggc gtgcacacct tccccgccgt gctgcagagc    540
agcggcctgt acagcctgag cagcgtggtg accgtgccca gcagcagcct gggcacccag    600
acctacatct gcaacgtgaa ccacaagccc agcaacacca aggtggacaa gcgcgtggag    660
cccaagagct gcgacaagac ccacacctgc cccccctgcc ctgccccga gctgctgggc    720 ggaccctccg tgttcctgtt ccccccaag cccaaggaca ccctcatgat cagccggacc    780
cccgaggtga cctgcgtggt ggtggacgtg agccacgagg accccgaggt gaagttcaac    840
tggtacgtgg acggcgtgga ggtgcacaac gccaagacca gccccgggaa ggagcagtac    900
aacagcacct accgggtggt gagcgtgctc accgtgctgc accaggactg gctgaacggc    960
aaggagtaca agtgcaaggt gagcaacaag gccctgcctg cccccatcga aaagaccatc   1020
agcaaggcca agggccagcc ccgggagccc caggtgtaca ccctgccccc cagccgggag   1080
gagatgacca agaaccaggt gtccctcacc tgtctggtga agggcttcta ccccagcgac   1140
atcgccgtgg agtgggagag caacggccag cccgagaaca actacaagac cacccccct   1200 gtgctggaca gcgacggcag cttcttcctg tacagcaagc tcaccgtgga caagagccgg   1260
tggcagcagg gcaacgtgtt cagctgcagc gtgatgcacg aggccctgca caaccactac   1320
acccagaaga gcctgagcct gagccccggc aag                                1353

CR6296 Heavy Chain amino acid sequence
                                                       (SEQ ID NO: 461)
EVQLVETGAEVKKPGASVKVSCKASGYTFTSYYMHWVRQAPGQGLEWMGWINPNSGGTN

YAQKFQGRVTMTRDTSISTAYMELSRLRSDDTAVYYCAREGKWGPQAAFDIWGQGTMVTV

SSASTKGPSVFPLAPSSKSTSGGTAALGCLVKDYFPEPVTVSWNSGALTSGVHTFPAVLQSSG

LYSLSSVVTVPSSSLGTQTYICNVNHKPSNTKVDKRVEPKSCDKTHTCPPCPAPELLGGPSVFL

FPPKPKDTLMISRTPEVTCVVVDVSHEDPEVKFNWYVDGVEVHNAKTKPREEQYNSTYRVV

SVLTVLHQDWLNGKEYKCKVSNKALPAPIEKTISKAKGQPREPQVYTLPPSREEMTKNQVSL

TCLVKGFYPSDIAVEWESNGQPENNYKTTPPVLDSDGSFFLYSKLTVDKSRWQQGNVFSCSV

MHEALHNHYTQKSLSLSPGK

CR6296 VH amino acid sequence
                                                       (SEQ ID NO: 459)
EVQLVETGAEVKKPGASVKVSCKASGYTFTSYYMHWVRQAPGQGLEWMGWINPNSGGTN

YAQKFQGRVTMTRDTSISTAYMELSRLRSDDTAVYYCAREGKWGPQAAFDIWGQGTMVTV

SS
```

CR6296 Light Chain nucleotide sequence
(SEQ ID NO: 463)
```
gaaattgtga tgacgcagtc tccaggcacc ctgtctttgt ctccagggga aagagccacc    60
ctctcctgca gggccagtca gagtgttagc agcagctact tagcctggta ccagcagaaa   120
cctggccagg ctcccaggct cctcatctat gatgcatcca gcagggccac tgacatccca   180
gacaggttca gtggcagtgg gtctgggaca gacttcactc tcaccatcag cagactggag   240
cctgaagatt ttgcagtgta ttactgtcag cagtatggta gctcactttg gacgttcggc   300
caagggacca aggtggagat caaacgtgcg gccgcaccca gcgtgttcat cttcccccc   360 tccgacgagc agctgaagag cggcaccgcc agcgtggtgt gcctgctgaa caacttctac   420
ccccgggagg ccaaggtgca gtggaaggtg gacaacgccc tgcagagcgg caacagccag   480
gagagcgtga ccgagcagga cagcaaggac tccacctaca gcctgagcag cacccctcacc   540 ctgagcaagg ccgactacga aagcacaag gtgtacgcct gcgaggtgac ccaccagggc   600
ctgagcagcc ccgtgaccaa gagcttcaac cggggcgagt gt                       642
```

CR6296 Light Chain amino acid sequence
(SEQ ID NO: 464)
EIVMTQSPGTLSLSPGERATLSCRASQSVSSSYLAWYQQKPGQAPRLLIYDASSRATDIPDRFS

GSGSGTDFTLTISRLEPEDFAVYYCQQYGSSLWTFGQGTKVEIKRAAAPSVFIFPPSDEQLKSG

TASVVCLLNNFYPREAKVQWKVDNALQSGNSQESVTEQDSKDSTYSLSSTLTLSKADYEKH

KVYACEVTHQGLSSPVTKSFNRGEC

CR6296 VL amino acid sequence
(SEQ ID NO: 462)
EIVMTQSPGTLSLSPGERATLSCRASQSVSSSYLAWYQQKPGQAPRLLIYDASSRATDIPDRFS

GSGSGTDFTLTISRLEPEDFAVYYCQQYGSSLWTFGQGTKVEIKR

The CR6301 HA-specific IgG antibody includes a heavy chain variable region (SEQ ID NO: 465) encoded by the heavy chain nucleotide sequence shown in SEQ ID NO: 466 and the heavy chain amino acid sequence shown in SEQ ID NO: 467. The CR6301 HA-specific IgG antibody also includes a light chain variable region (SEQ ID NO: 468) encoded by the light chain nucleotide sequence shown in SEQ ID NO: 469 and the light chain amino acid sequence shown in SEQ ID NO: 470.

CR6301 Heavy Chain nucleotide sequence
(SEQ ID NO: 466)
```
gaggtgcagc tggtagagtc tgggggaggc ttggtacagc ctggggggtc cctgagactc    60
tcctgtgcag cctctggatt caccttttagc atctatgcca tgagctgggt ccgccaggca   120
ccagggaagg gctggagtg gtctcagct attagtagta gtggtgatag cacatactac   180
gcagactccg tgaagggccg gttcaccatc tccagagaca acgccaggaa cacgctgtat   240
ctgcaaatga acagtctgag agccgaggac acggctgtgt attactgtgc gagagcgtat   300
ggctacacgt tcgaccctg gggcaggga accctggtca ccgtctcgag tgctagcacc   360
aagggcccca gcgtgttccc cctggcccc agcagcaaga gcaccagcgg cggcacagcc   420
gccctgggct gcctggtgaa ggactacttc cccgagcccg tgaccgtgag ctggaacagc   480
ggcgccttga ccagcggcgt gcacaccttc ccggccgtgc tgcagagcag cggcctgtac   540
agcctgagca gcgtggtgac cgtgcccagc agcagcctgg gcacccagac ctacatctgc   600
aacgtgaacc acaagccag caacaccaag gtggacaaac gcgtggagcc caagagctgc   660
gacaagaccc acacctgccc ccctgccct gccccgagc tgctgggcgg accctccgtg   720
ttcctgttcc ccccaagcc caaggacacc ctcatgatca gccggaccc cgaggtgacc   780 tgcgtggtgg tggacgtgag ccacgaggac cccgaggtga agttcaactg gtacgtggac   840
ggcgtggagg tgcacaacgc caagaccaag ccccgggagg agcagtacaa cagcacctac   900
```

-continued

```
cgggtggtga gcgtgctcac cgtgctgcac caggactggc tgaacggcaa ggagtacaag    960
tgcaaggtga gcaacaaggc cctgcctgcc cccatcgaga agaccatcag caaggccaag   1020
ggccagcccc gggagcccca ggtgtacacc ctgccccca gccgggagga gatgaccaag   1080
aaccaggtgt ccctcacctg tctggtgaag ggcttctacc ccagcgacat cgccgtggaa   1140
tgggagagca acggccagcc cgagaacaac tacaagacca ccccccctgt gctggacagc   1200
gacggcagct tcttcctgta cagcaagctc accgtggaca gagccggtg gcagcagggc   1260
aacgtgttca gctgcagcgt gatgcacgag gccctgcaca accactacac ccagaagagc   1320
ctgagcctga gccccggcaa g                                             1341
```

CR6301 Heavy Chain amino acid sequence
(SEQ ID NO: 467)

EVQLVESGGGLVQPGGSLRLSCAASGFTFSIYAMSWVRQAPGKGLEWVSAISSSGDSTYYAD

SVKGRFTISRDNARNTLYLQMNSLRAEDTAVYYCARAYGYTFDPWGQGTLVTVSSASTKGP

SVFPLAPSSKSTSGGTAALGCLVKDYFPEPVTVSWNSGALTSGVHTFPAVLQSSGLYSLSSVV

TVPSSSLGTQTYICNVNHKPSNTKVDKRVEPKSCDKTHTCPPCPAPELLGGPSVFLFPPKPKDT

LMISRTPEVTCVVVDVSHEDPEVKFNWYVDGVEVHNAKTKPREEQYNSTYRVVSVLTVLHQ

DWLNGKEYKCKVSNKALPAPIEKTISKAKGQPREPQVYTLPPSREEMTKNQVSLTCLVKGFY

PSDIAVEWESNGQPENNYKTTPPVLDSDGSFFLYSKLTVDKSRWQQGNVFSCSVMHEALHN

HYTQKSLSLSPGK

CR6301 VH amino acid sequence
(SEQ ID NO: 465)

EVQLVESGGGLVQPGGSLRLSCAASGFTFSIYAMSWVRQAPGKGLEWVSAISSSGDSTYYAD

SVKGRFTISRDNARNTLYLQMNSLRAEDTAVYYCARAYGYTFDPWGQGTLVTVSS

CR6301 Light Chain nucleotide sequence
(SEQ ID NO: 469)
```
gaaattgtgc tgactcagtc tccactctcc ctgcccgtca cccctggaga gccggcctcc     60
atctcctgca ggtctagtca gagcctcctg catagtaatg gatacaacta tttggattgg    120
tacctgcaga agccagggca gtctccacag ctcctgatct atttgggttc taatcgggcc    180
tccggggtcc ctgacaggtt cagtggcagt ggatcaggca cagatttac actgaaaatc    240
agcagagtgg aggctgagga tgttggggtt tattactgca tgcaagctct acaaactccc    300
ctcactttcg gcggagggac caaggtggag atcaaacgtg cggccgcacc cagcgtgttc    360
atcttccccc cctccgacga gcagctgaag agcggcaccg ccagcgtggt gtgcctgctg    420
aacaacttct acccccggga ggccaaggtg cagtggaagg tggacaacgc cctgcagagc    480
ggcaacagcc aggagagcgt gaccgagcag gacagcaagg actccaccta cagcctgagc    540
agcaccctca ccctgagcaa ggccgactac gagaagcaca aggtgtacgc ctgcgaggtg    600
acccaccagg gcctgagcag ccccgtgacc aagagcttca accggggcga gtgt          654
```

CR6301 Light Chain amino acid sequence
(SEQ ID NO: 470)

EIVLTQSPLSLPVTPGEPASISCRSSQSLLHSNGYNYLDWYLQKPGQSPQLLIYLGSNRASGVP

DRFSGSGSGTDFTLKISRVEAEDVGVYYCMQALQTPLTFGGGTKVEIKRAAAPSVFIFPPSDE

QLKSGTASVVCLLNNFYPREAKVQWKVDNALQSGNSQESVTEQDSKDSTYSLSSTLTLSKA

DYEKHKVYACEVTHQGLSSPVTKSFNRGEC

CR6301 VL amino acid sequence
(SEQ ID NO: 468)

EIVLTQSPLSLPVTPGEPASISCRSSQSLLHSNGYNYLDWYLQKPGQSPQLLIYLGSNRASGVP

DRFSGSGSGTDFTLKISRVEAEDVGVYYCMQALQTPLTFGGGTKVEIKR

The CR6307 HA-specific IgG antibody includes a heavy chain variable region (SEQ ID NO: 471) encoded by the heavy chain nucleotide sequence shown in SEQ ID NO: 472 and the heavy chain amino acid sequence shown in SEQ ID NO: 473. The CR6307 HA-specific IgG antibody also includes a light chain variable region (SEQ ID NO: 474) encoded by the light chain nucleotide sequence shown in SEQ ID NO: 475 and the light chain amino acid sequence shown in SEQ ID NO: 476.

```
CR6307 Heavy Chain nucleotide sequence
                                                     (SEQ ID NO: 472)
caggtccagc tggtgcagtc tgggggaggc ctggtcaagc ctgggggtc cctgagactc     60 tcctgtgcag cctctggatt caccttcagt agctatagca tgaactgggt ccgccaggct   120
ccagggaagg ggctggagtg ggtctcatcc attagtagta gtagtagtta catatactac   180
gtagactcag tgaagggccg attcaccatc tccagagaca acgccaagaa ctcactgtat   240
ctgcaaatga acagcctgag agccgaggac acggctgtgt attactgtgc gagaggtggt   300
gggagctacg gggcctacga aggctttgac tactggggcc agggcaccct ggtcaccgtc   360
tcgagtgcta gcaccaaggg cccatcggtc ttccccctgg caccctcctc caagagcacc   420
agcggcggca cagccgccct gggctgcctg gtgaaggact acttccccga gccggtgacc   480
gtgagctgga acagcggcgc cttgaccagc ggcgtgcaca cctttcccgc cgtgctgcag   540
agcagcggcc tgtacagcct gagcagcgtg gtgaccgtgc cagcagcag cctgggcacc   600 cagacctaca tctgcaacgt gaaccacaag cccagcaaca ccaaggtgga caaacgcgtg   660
gagcccaaga gctgcgacaa gacccacacc tgcccccct gccctgcccc cgagctgctg   720
ggcggaccct ccgtgttcct gttccccccc aagcccaagg acaccctcat gatcagccgg   780
acccccgagg tgacctgcgt ggtggtggac gtgagccacg aggacccga ggtgaagttc   840 aactggtacg tggacggcgt ggaggtgcac aacgccaaga ccaagccccg ggaggagcag   900
tacaacagca cctaccgggt ggtgagcgtg ctcaccgtgc tgcaccagga ctggctgaac   960
ggcaaggagt acaagtgcaa ggtgagcaac aaggccctgc ctgccccat cgagaagacc  1020 atcagcaagg ccaagggcca gccccgggag ccccaggtgt acaccctgcc cccagccgg  1080 gaggagatga ccaagaacca ggtgtccctc acctgtctgg tgaagggctt ctaccccagc  1140
gacaccgccg tggagtggga gagcaacggc cagcccgaga caactacaa gaccaccccc  1200 cctgtgctgg acagcgacgg cagcttcttc ctgtacagca agctcaccgt ggacaagagc  1260
cggtggcagc agggcaacgt gttcagctgc agcgtgatgc acgaggccct gcacaaccac  1320
tacacccaga gagcctgag cctgagcccc ggcaag                             1356

CR6307 Heavy Chain amino acid sequence
                                                     (SEQ ID NO: 473)
QVQLVQSGGGLVKPGGSLRLSCAASGFTFSSYSMNWVRQAPGKGLEWVSSISSSSSYIYYVD

SVKGRFTISRDNAKNSLYLQMNSLRAEDTAVYYCARGGGSYGAYEGFDYWGQGTLVTVSS

ASTKGPSVFPLAPSSKSTSGGTAALGCLVKDYFPEPVTVSWNSGALTSGVHTFPAVLQSSGLY

SLSSVVTVPSSSLGTQTYICNVNHKPSNTKVDKRVEPKSCDKTHTCPPCPAPELLGGPSVFLFP

PKPKDTLMISRTPEVTCVVVDVSHEDPEVKFNWYVDGVEVHNAKTKPREEQYNSTYRVVSV

LTVLHQDWLNGKEYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRWQQGNVFSCSVM

HEALHNHYTQKSLSLSPGK

CR6307 VH amino acid sequence
```

(SEQ ID NO: 471)
QVQLVQSGGGLVKPGGSLRLSCAASGFTFSSYSMNWVRQAPGKGLEWVSSISSSSSYIYYVD

SVKGRFTISRDNAKNSLYLQMNSLRAEDTAVYYCARGGGSYGAYEGFDYWGQGTLVTVSS

CR6307 Light Chain nucleotide sequence
(SEQ ID NO: 475)

```
gaaattgtgc tgactcagtc tccaggcacc ctgtctttgt ctccagggga aagagccacc    60
ctctcctgca gggccagtca gcgtgttagc agctacttag cctggtacca acagaaacct   120
ggccaggctc ccaggctcct catctatggt gcatccacca gggccgctgg catcccagac   180
aggttcagtg gcagtgggtc tgggacagac ttcactctca ccatcagcag actggagcct   240
gaagattctg cagtgtatta ctgtcagcag tatggtagga caccgctcac tttcggcgga   300
gggaccaagg tggagatcaa acgtgcggcc gcacccagcg tgttcatctt cccccctcc   360
gacgagcagc tgaagagcgg caccgccagc gtggtgtgcc tgctgaacaa cttctacccc   420
cgggaggcca aggtgcagtg gaaggtggac aacgccctgc agagcggcaa cagccaggag   480
agcgtgaccg agcaggacag caaggactcc acctacagcc tgagcagcac cctcaccctg   540
agcaaggccg actacgagaa gcacaaggtg tacgcctgcg aggtgaccca ccagggcctg   600
agcagccccg tgaccaagag cttcaaccgg ggcgagtgt                          639
```

CR6307 Light Chain amino acid sequence
(SEQ ID NO: 476)
EIVLTQSPGTLSLSPGERATLSCRASQRVSSYLAWYQQKPGQAPRLLIYGASTRAAGIPDRFSG

SGSGTDFTLTISRLEPEDSAVYYCQQYGRTPLTFGGGTKVEIKRAAAPSVFIFPPSDEQLKSGT

ASVVCLLNNFYPREAKVQWKVDNALQSGNSQESVTEQDSKDSTYSLSSTLTLSKADYEKHK

VYACEVTHQGLSSPVTKSFNRGEC

CR6307 VL amino acid sequence
(SEQ ID NO: 474)
EIVLYQSPGTLSLSPGERATLSCRASQRVSSYLAWYQQKPGQAPRLLIYGASTRAAGIPDRFS

GSGSGTDFTLTISRLEPEDSAVYYCQQYGRTPLTFGGGTKVEIKR

The CR6310 HA-specific IgG antibody includes a heavy chain variable region (SEQ ID NO: 477) encoded by the heavy chain nucleotide sequence shown in SEQ ID NO: 478 and the heavy chain amino acid sequence shown in SEQ ID NO: 479. The CR6310 HA-specific IgG antibody also includes a light chain variable region (SEQ ID NO: 480) encoded by the light chain nucleotide sequence shown in SEQ ID NO: 481 and the light chain amino acid sequence shown in SEQ ID NO: 482.

CR6310 Heavy Chain nucleotide sequence
(SEQ ID NO: 478)

```
gaggtgcagc tggtggagtc tggggctgag gtgaagaagc ctgggtcctc ggtgaaagtc    60
tcttgcaagg cttctggagg ccccttccgc agctatgcta tcagctgggt gcgacaggcc   120
cctggacaag gcctgagtg gatgggaggg atcatcccta tttttggtac aacaaaatac   180
gcaccgaagt tccagggcag agtcacgatt accgcggacg atttcgcggg cacagtttac   240
atggagctga gcagcctgcg atctgaggac acggccatgt actactgtgc gaaacatatg   300
gggtaccagg tgcgcgaaac tatgacgtc tggggcaaag ggaccacggt caccgtctcg   360
agtgctagca ccaagggccc cagcgtgttc ccctggccc ccagcagcaa gagcaccagc   420
ggcggcacag ccgccctggg ctgcctggtg aaggactact cccccgagcc cgtgaccgtg   480
agctggaaca gcggcgcctt gaccagcggc gtgcacacct tccccgccgt gctgcagagc   540
agcggcctgt acagcctgag cagcgtggtg accgtgccca gcagcagcct gggcacccag   600
acctacatct gcaacgtgaa ccacaagccc agcaacacca aggtggacaa gcgcgtggag   660
cccaagagct gcgacaagac ccacacctgc cccccctgcc ctgccccga gctgctgggc   720
ggaccctccg tgttcctgtt ccccccaag cccaaggaca ccctcatgat cagccggacc   780
```

-continued

```
cccgaggtga cctgcgtggt ggtggacgtg agccacgagg accccgaggt gaagttcaac    840
tggtacgtgg acggcgtgga ggtgcacaac gccaagacca gccccgggag gagcagtac     900 aacagcacct accgggtggt gagcgtgctc accgtgctgc accaggactg gctgaacggc    960
aaggagtaca agtgcaaggt gagcaacaag gccctgcctg cccccatcga aagaccatc   1020 agcaaggcca agggccagcc ccgggagccc caggtgtaca ccctgccccc cagccgggag  1080
gagatgacca agaaccaggt gtccctcacc tgtctggtga agggcttcta ccccagcgac  1140
atcgccgtgg agtgggagag caacggccag cccgagaaca actacaagac ccccccct    1200 gtgctggaca gcgacggcag cttcttcctg tacagcaagc tcaccgtgga caagagccgg  1260
tggcagcagg gcaacgtgtt cagctgcagc gtgatgcacg aggccctgca caaccactac  1320
acccagaaga gcctgagcct gagccccggc aag                                1353
```

CR6310 Heavy Chain amino acid sequence
(SEQ ID NO: 479)
EVQLVESGAEVKKPGSSVKVSCKASGGPFRSYAISWVRQAPGQGPEWMGGIIPIFGTTKYAP

KFQGRVTITADDFAGTVYMELSSLRSEDTAMYYCAKHMGYQVRETMDVWGKGTTVTVSSA

STKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRWQQGNVFSCSVMH

EALHNHYTQKSLSLSPGK

CR6310 VH amino acid sequence
(SEQ ID NO: 477)
EVQLVESGAEVKKPGSSVKVSCKASGGPFRSYAISWVRQAPGQGPEWMGGIIPIFGTTKYAP

KFQGRVTITADDFAGTVYMELSSLRSEDTAMYYCAKHMGYQVRETMDVWGKGTTVTVSS

CR6310 Light Chain nucleotide sequence
(SEQ ID NO: 481)
```
tcctatgtgc tgactcagcc accctcggtg tcagtggccc caggacagac ggccaggatt     60
acctgtgggg gaaacaacat tggaagtaaa agtgtgcact ggtaccagca gaagccaggc    120
caggcccctg tgctggtcgt ctatgatgat agcgaccggc cctcagggat ccctgagcga    180
ttctctggct ccaactctgg gaacacggcc accctgacca tcagcagggt cgaagccggg    240
gatgaggccg actattactg tcaggtgtgg gatagtagta gtgatcatgc tgtgttcgga    300
ggaggcaccc agctgaccgt cctcggtgcg gccgcaggcc agcccaaggc cgctcccagc    360
gtgaccctgt tccccccctc ctccgaggag ctgcaggcca acaaggccac cctggtgtgc    420
ctcatcagcg acttctaccc tggcgccgtg accgtggcct ggaaggccga cagcagcccc    480
gtgaaggccg gcgtggagac caccacccc agcaagcaga gcaacaacaa gtacgccgcc    540
agcagctacc tgagcctcac cccgagcag tggaagagcc accggagcta cagctgccag    600
gtgacccacg agggcagcac cgtggagaag accgtggccc ccaccgagtg cagc          654
```

CR6310 Light Chain amino acid sequence
(SEQ ID NO: 482)
SYVLTQPPSVSVAPGQTARITCGGNNIGSKSVHWYQQKPGQAPVLVVYDDSDRPSGIPERFSG

SNSGNTATLTISRVEAGDEADYYCQVWDSSSDHAVFGGGTQLTVLGAAAGQPKAAPSVTLF

```
                                              -continued
PPSSEELQANKATLVCLISDFYPGAVTVAWKADSSPVKAGVETTTPSKQSNNKYAASSYLSL

TPEQWKSHRSYSCQVTHEGSTVEKTVAPTECS

CR6310 VL amino acid sequence
                                                                (SEQ ID NO: 480)
SYVLTQPPSVSVAPGQTARITCGGNNIGSKSVHWYQQKPGQAPVLVVYDDSDRPSGIPERFSG

SNSGNTATLTISRVEAGDEADYYCQVWDSSSDHAVFGGGTQLTVLG
```

The CR6314 HA-specific IgG antibody includes a heavy chain variable region (SEQ ID NO: 483) encoded by the heavy chain nucleotide sequence shown in SEQ ID NO: 484 and the heavy chain amino acid sequence shown in SEQ ID NO: 485. The CR6314 HA-specific IgG antibody also includes a light chain variable region (SEQ ID NO: 486) encoded by the light chain nucleotide sequence shown in SEQ ID NO: 487 and the light chain amino acid sequence shown in SEQ ID NO: 488.

```
CR6314 Heavy Chain nucleotide sequence
                                                                (SEQ ID NO: 484)
gaggtgcagc tggtggagtc tggggctgag gtgaagaagc ctgggtcctc ggtgaaagtc      60
tcttgcaagg cttctggagg ccccttccgc agctatgcta tcagctgggt gcgacaggcc     120
cctggacaag ggcctgagtg gatgggaggg atcatcccta tttttggtac aacaaaatac     180
gcaccgaagt tccagggcag agtcacgatt accgcggacg atttcgcggg cacagtttac     240
atggagctga gcagcctgcg atctgaggac acggccatgt actactgtgc gaaacatatg     300
gggtaccagg tgcgcgaaac tatggacgtc tggggcaaag ggaccacggt caccgtctcg     360
agtgctagca ccaagggccc cagcgtgttc ccctggccc ccagcagcaa gagcaccagc      420
ggcggcacag ccgccctggg ctgcctggtg aaggactact cccccgagcc cgtgaccgtg     480
agctggaaca gcggcgcctt gaccagcggc gtgcacacct ccccgccgt gctgcagagc      540 agcggcctgt acagcctgag cagcgtggtg accgtgccca gcagcagcct gggcacccag     600
acctacatct gcaacgtgaa ccacaagccc agcaacacca aggtggacaa gcgcgtggag     660
cccaagagct gcgacaagac ccacacctgc ccccctgcc ctgccccga gctgctgggc       720 ggaccctccg tgttcctgtt cccccccaag cccaaggaca ccctcatgat cagccggacc     780
cccgaggtga cctgcgtggt ggtggacgtg agccacgagg acccccgaggt gaagttcaac    840 tggtacgtgg acggcgtgga ggtgcacaac gccaagacca gccccggga ggagcagtac      900 aacagcacct accgggtggt gagcgtgctc accgtgctgc accaggactg gctgaacggc     960
aaggagtaca gtgcaaggt gagcaacaag gccctgcctg ccccatcga aagaccatc       1020 agcaaggcca agggccagcc ccgggagccc caggtgtaca ccctgccccc cagccgggag    1080
gagatgacca gaaccaggt gtccctcacc tgtctggtga agggcttcta ccccagcgac     1140
atcgccgtgg agtgggagag caacggccag cccgagaaca actacaagac caccccccct    1200
gtgctggaca cgacggcag cttcttcctg tacagcaagc tcaccgtgga caagagccgg     1260
tggcagcagg gcaacgtgtt cagctgcagc gtgatgcacg aggccctgca caaccactac    1320
acccagaaga gcctgagcct gagccccggc aag                                 1353

CR6314 Heavy Chain amino acid sequence
                                                                (SEQ ID NO: 485)
EVQLVESGAEVKKPGSSVKVSCKASGGPFRSYAISWVRQAPGQGPEWMGGIIPIFGTTKYAP

KFQGRVTITADDFAGTVYMELSSLRSEDTAMYYCAKHMGYQVRETMDVWGKGTTVTVSSA

STKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCL
```

VKGFYPSDIAVEWESNGQPENNYKTTPPVLDSDGSFFLYSKLTVDKSRWQQGNVFSCSVMH

EALHNHYTQKSLSLSPGK

CR6314 VH amino acid sequence
(SEQ ID NO: 483)
EVQLVESGAEVKKPGSSVKVSCKASGGPFRSYAISWVRQAPGQGPEWMGGIIPIFGTTKYAP

KFQGRVTITADDFAGTVYMELSSLRSEDTAMYYCAKHMGYQVRETMDVWGKGTTVTVSS

CR6314 Light Chain nucleotide sequence
(SEQ ID NO: 487)

```
tcctatgtgc tgactcagcc accctcagcg tctgggaccc ccgggcagag ggtcaccatc     60
tcttgttctg gaagcagctc caacatcgga agtaattatg tatactggta ccagcagctc    120
ccaggcacgg cccccaaact cctcatctat agggatggtc agcggccctc aggggtccct    180
gaccgattct ctggctccaa gtctggcacc tcagcctccc tggccatcag tggactccgg    240
tccgatgatg aggctgatta ttactgtgca acatgggatg acaacctgag tggtccagta    300
ttcggcggag ggaccaagct gaccgtccta ggtgcggccg caggccagcc caaggccgct    360
cccagcgtga ccctgttccc ccctcctcc gaggagctgc aggccaacaa ggccaccctg     420
gtgtgcctca tcagcgactt ctaccctggc gccgtgaccg tggcctggaa ggccgacagc    480
agccccgtga aggccggcgt ggagaccacc accccagca agcagagcaa caacaagtac     540
gccgccagca gctacctgag cctcaccccc gagcagtgga gagccaccg gagctacagc     600 tgccaggtga cccacgaggg cagcaccgtg gagaagaccg tggcccccac cgagtgcagc    660
```

CR6314 Light Chain amino acid sequence
(SEQ ID NO: 488)
SYVLTQPPSASGTPGQRVTISCSGSSSNIGSNYVYWYQQLPGTAPKLLIYRDGQRPSGVPDRFS

GSKSGTSASLAISGLRSDDEADYYCATWDDNLSGPVFGGGTKLTVLGAAAQPKAAPSVTLFP

PSSEELQANKATLVCLISDFYPGAVTVAWKADSSPVKAGVETTTPSKQSNNKYAASSYLSLT

PGQWKSHRSYSCQVTHEGSTVEKTVAPTECSG

CR6314 VL amino acid sequence
(SEQ ID NO: 486)
SYVLTQPPSASGTPGQRVTISCSGSSSNIGSNYVYWYQQLPGTAPKLLIYRDGQRPSGVPDRFS

GSKSGTSASLAISGLRSDDEADYYCATWDDNLSGPVFGGGTKLTVLG

The CR6323 HA-specific IgG antibody includes a heavy chain variable region (SEQ ID NO: 489) encoded by the heavy chain nucleotide sequence shown in SEQ ID NO: 490 and the heavy chain amino acid sequence shown in SEQ ID NO: 491. The CR6323 HA-specific IgG antibody also includes a light chain variable region (SEQ ID NO: 492) encoded by the light chain nucleotide sequence shown in SEQ ID NO: 493 and the light chain amino acid sequence shown in SEQ ID NO: 494.

CR6323 Heavy Chain nucleotide sequence
(SEQ ID NO: 490)

```
gaggtgcagc tggtggagtc tggggctgag gtgaagaagc cagggtcctc ggtgaaggtc     60
tcctgtaagg cctctggagg caccttctcc agctatggta tcagctgggt gcgacaggcc    120
cctggacaag ggcttgagtg gatgggagac atcatcggta tgtttggttc aacaaactac    180
gcacagaact tccagggcag actcacgatt accgcggacg aatccacgag cacagcctac    240
atggagctga gcagcctgag atctgaggac acggccgtgt attactgtgc gagaagtagt    300
ggttattacc ctgcatacct cccccactgg ggccagggca ccttggtcac cgtctcgagt    360
gctagcacca agggcccag cgtgttcccc ctggccccca gcagcaagag caccagcggc    420
ggcacagccg ccctgggctg cctggtgaag gactacttcc ccgagcccgt gaccgtgagc    480
tggaacagcg gcgccttgac cagcggcgtg cacaccttcc ccgccgtgct gcagagcagc    540
ggcctgtaca gcctgagcag cgtggtgacc gtgcccagca gcagcctggg cacccagacc    600
```

```
tacatctgca acgtgaacca caagcccagc aacaccaagg tggacaaacg cgtggagccc    660
aagagctgcg acaagaccca cacctgcccc cctgccctg ccccgagct gctgggcgga     720 ccctccgtgt tcctgttccc ccccaagccc aaggacaccc tcatgatcag ccggacccc     780 gaggtgacct gcgtggtggt ggacgtgagc cacgaggacc ccgaggtgaa gttcaactgg   840
tacgtggacg gcgtggaggt gcacaacgcc aagaccaagc ccgggagga gcagtacaac    900 agcacctacc gggtggtgag cgtgctcacc gtgctgcacc aggactggct gaacggcaag   960
gagtacaagt gcaaggtgag caacaaggcc ctgcctgccc ccatcgagaa gaccatcagc  1020
aaggccaagg gccagccccg ggagcccag gtgtacaccc tgcccccag ccggaggag     1080 atgaccaaga accaggtgtc cctcacctgt ctggtgaagg gcttctaccc cagcgacatc  1140
gccgtggagt gggagagcaa cggccagccc gagaacaact acaagaccac ccccctgtg   1200 ctggacagcg acggcagctt cttcctgtac agcaagctca ccgtggacaa gagccggtgg  1260
cagcagggca acgtgttcag ctgcagcgtg atgcacgagg ccctgcacaa ccactacacc  1320
cagaagagcc tgagcctgag ccccggcaag                                    1350

CR6323 Heavy Chain amino acid sequence
                                                (SEQ ID NO: 491)
EVQLVESGAEVKKPGSSVKVSCKASGGTFSSYGISWVRQAPGQGLEWMGDIIGMFGSTNYA

QNFQGRLTITADESTSTAYMELSSLRSEDTAVYYCARSSGYYPAYLPHWGQGTLVTVSSAST

KGPSVFPLAPSSKSTSGGTAALGCLVKDYFPEPVTVSWNSGALTSGVHTFPAVLQSSGLYSLS

SVVTVPSSSLGTQTYICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYNSTYRVVSVLTV

LHQDWLNGKEYKCKVSNKALPAPIEKTISKAKGQPREPQVYTLPPSREEMTKNQVSLTCLVK

GFYPSDIAVEWESNGQPENNYKTTPPVLDSDGSFFLYSKLTVDKSRWQQGNVFSCSVMHEAL

HNHYTQKSLSLSPGK

CR6323 VH amino acid sequence
                                                (SEQ ID NO: 489)
EVQLVESGAEVKKPGSSVKVSCKASGGTFSSYGISWVRQAPGQGLEWMGDIIGMFGSTNYA

QNFQGRLTITADESTSTAYMELSSLRSEDTAVYYCARSSGYYPAYLPHWGQGTLVTVSS

CR6323 Light Chain nucleotide sequence
                                                (SEQ ID NO: 493)
gaaattgtgt tgacccagtc tccaggcacc ctgtctttgt ctccagggga aagagccacc    60
ctctcctgca gggccagtca gagtgttagc agcagctact tagcctggta ccagcagaaa  120
cctggccagg ctcccaggct cctcatctat ggtgcatcca gcagggccac tggcatccca  180
gacaggttca gtggcagtgg gtctgggaca gacttcactc tcaccatcag cagactggag  240
cctgaagatt ttgcagtgta ttactgtcag cagtatggta gctcacccag aactttcggc  300
ggagggacca aggtggagat caaacgtgcg gccgcaccca gcgtgttcat cttcccccc   360 tccgacgagc agctgaagag cggcaccgcc agcgtggtgt gcctgctgaa caacttctac  420 cccgggagg ccaaggtgca gtggaaggtg gacaacgccc tgcagagcgg caacagccag   480
gagagcgtga ccgagcagga cagcaaggac tccacctaca gcctgagcag cacctcacc   540 ctgagcaagg ccgactacga gaagcacaag gtgtacgcct gcgaggtgac ccaccaggc   600 ctgagcagcc ccgtgaccaa gagcttcaac cggggcgagt gt                     642

CR6323 Light Chain amino acid sequence
                                                (SEQ ID NO: 494)
EIVLTQSPGTLSLSPGERATLSCRASQSVSSSYLAWYQQKPGQAPRLLIYGASSRATGIPDRFS

GSGSGTDFTLTISRLEPEDFAVYYCQQYGSSPRTFGGGTKVEIKRAAAPSVFIFPPSDEQLKSG
```

```
TASVVCLLNNFYPREAKVQWKVDNALQSGNSQESVTEQDSKDSTYSLSSTLTLSKADYEKH

KVYACEVTHQGLSSPVTKSFNRGEC

CR6323 VL amino acid sequence
                                                        (SEQ ID NO: 492)
EIVLTQSPGTLSLSPGERATLSCRASQSVSSSYLAWYQQKPGQAPRLLIYGASSRATGIPDRFS

GSGSGTDFTLTISRLEPEDFAVYYCQQYGSSPRTFGGGTKVEIKR
```

The CR6325 HA-specific IgG antibody includes a heavy chain variable region (SEQ ID NO: 495) encoded by the heavy chain nucleotide sequence shown in SEQ ID NO: 496 and the heavy chain amino acid sequence shown in SEQ ID NO: 497. The CR6325 HA-specific IgG antibody also includes a light chain variable region (SEQ ID NO: 498) encoded by the light chain nucleotide sequence shown in SEQ ID NO: 499 and the light chain amino acid sequence shown in SEQ ID NO: 500.

```
CR6325 Heavy Chain nucleotide sequence
                                                        (SEQ ID NO: 496)
gaggtgcagc tggtggagtc tggggctgag gtgaagaagc cggggtcctc ggtgaaggtc    60
tcctgcaagg cttctggagg caccttcagc ttctattcta tgagctgggt gcgacaggcc   120
cctggacaag gacttgagtg gatgggaggg atcatcccta tgtttggtac aacaaactac   180
gcacagaagt tccagggcag agtcacgatt accgcggtcg aatccacgag cacagcctac   240
atggaggtga gcagcctgag atctgaggac acggccgttt attactgtgc gagaggtgat   300
aagggtatct actactacta catggacgtc tggggcaaag ggaccacggt caccgtctcg   360
agtgctagca ccaagggccc cagcgtgttc ccctggccc ccagcagcaa gagcaccagc    420
ggcggcacag ccgccctggg ctgcctggtg aaggactact ccccgagcc cgtgaccgtg    480 agctggaaca gcggcgcctt gaccagcggc gtgcacacct ccccgccgt gctgcagagc    540 agcggcctgt acagcctgag cagcgtggtg accgtgccca gcagcagcct gggcacccag   600
acctacatct gcaacgtgaa ccacaagccc agcaacacca aggtggacaa acgcgtggag   660
cccaagagct gcgacaagac ccacacctgc ccccctgcc ctgccccga gctgctgggc     720 ggaccctccg tgttcctgtt cccccccaag cccaaggaca ccctcatgat cagccggacc   780
cccgaggtga cctgcgtggt ggtggacgtg agccacgagg accccgaggt gaagttcaac   840
tggtacgtgg acggcgtgga ggtgcacaac gccaagacca gccccggga ggagcagtac    900 aacagcacct accgggtggt gagcgtgctc accgtgctgc accaggactg gctgaacggc   960
aaggagtaca gtgcaaggt gagcaacaag gccctgcctg cccccatcga aagaccatc    1020 agcaaggcca agggccagcc ccggagccc caggtgtaca ccctgccccc cagccgggag   1080
gagatgacca gaaccaggt gtccctcacc tgtctggtga agggcttcta ccccagcgac   1140
atcgccgtgg agtgggagag caacggccag cccgagaaca actacaagac cacccccct    1200 gtgctggaca cgacggcag cttcttcctg tacagcaagc tcaccgtgga caagagccgg    1260
tggcagcagg gcaacgtgtt cagctgcagc gtgatgcacg aggccctgca caaccactac   1320
acccagaaga gcctgagcct gagccccggc aag                                1353

CR6325 Heavy Chain amino acid sequence
                                                        (SEQ ID NO: 497)
EVQLVESGAEVKKPGSSVKVSCKASGGTFSFYSMSWVRQAPGQGLEWMGGIIPMFGTTNYA

QKFQGRVTITAVESTSTAYMEVSSLRSEDTAVYYCARGDKGIYYYYMDVWGKGTTVTVSSA

STKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCL
```

-continued

VKGFYPSDIAVEWESNGQPENNYKTTPPVLDSDGSFFLYSKLTVDKSRWQQGNVFSCSVMH

EALHNHYTQKSLSLSPGK

CR6325 VH amino acid sequence
(SEQ ID NO: 495)
EVQLVESGAEVKKPGSSVKVSCKASGGTFSFYSMSWVRQAPGQGLEWMGGIIPMFGTTNYA

QKFQGRVTITAVESTSTAYMEVSSLRSEDTAVYYCARGDKGIYYYYMDVWGKGTTVTVSS

CR6325 Light Chain nucleotide sequence
(SEQ ID NO: 499)

```
cagtctgccc tgactcagcc tgcctccgtg tctgggtctc ctggacagtc gatcaccatc   60
tcctgcactg gaaccagcag tgacgttggt ggttataact atgtctcctg gtaccaacag  120
cacccaggca agccccaa actcatgatt tatgaggtca gtaatcggcc ctcaggggtt   180
tctaatcgct tctctggctc caagtctggc aacacggcct ccctgaccat ctctgggctc  240
caggctgagg acgaggctga ttattactgc agctcatata caagcagcag cactcttgtc  300
ttcggaactg ggaccaaggt caccgtccta ggtgcggccg caggccagcc caaggccgct  360
cccagcgtga ccctgttccc ccctcctcc gaggagctgc aggccaacaa ggccaccctg  420
gtgtgcctca tcagcgactt ctaccctggc gccgtgaccg tggcctggaa ggccgacagc  480
agccccgtga aggccggcgt ggagaccacc accccagca agcagagcaa caacaagtac  540
gccgccagca gctacctgag cctcaccccc gagcagtgga agagccaccg gagctacagc  600
tgccaggtga cccacgaggg cagcaccgtg gagaagaccg tggcccccac cgagtgcagc  660
```

CR6325 Light Chain amino acid sequence
(SEQ ID NO: 500)
QSALTQPASVSGSPGQSITISCTGTSSDVGGYNYVSWYQQHPGKAPKLMIYEVSNRPSGVSNR

FSGSKSGNTASLTISGLQAEDEADYYCSSYTSSSTLVFGTGTKVTVLGAAAGQPKAAPSVTLF

PPSSEELQANKATLVCLISDFYPGAVTVAWKADSSPVKAGVETTTPSKQSNNKYAASSYLSL

TPEQWKSHRSYSCQVTHEGSTVEKTVAPTECS

CR6325 VL amino acid sequence
(SEQ ID NO: 498)
QSALTQPASVSGSPGQSITISCTGTSSDVGGYNYVSWYQQHPGKAPKLMIYEVSNRPSGVSNR

FSGSKSGNTASLTISGLQAEDEADYYCSSYTSSSTLVFGTGTKVTVLG

The CR6327 HA-specific IgG antibody includes a heavy chain variable region (SEQ ID NO: 501) encoded by the heavy chain nucleotide sequence shown in SEQ ID NO: 502 and the heavy chain amino acid sequence shown in SEQ ID NO: 503. The CR6327 HA-specific IgG antibody also includes a light chain variable region (SEQ ID NO: 504) encoded by the light chain nucleotide sequence shown in SEQ ID NO: 505 and the light chain amino acid sequence shown in SEQ ID NO: 506.

CR6327 Heavy Chain nucleotide sequence
(SEQ ID NO: 502)

```
gaggtgcagc tggtggagac cggggctgag gtgaagaagc ctgggtcctc ggtgaaggtc   60
tcctgcaagg cctctggagg caccttcagg acccatgcta tcagttgggt gcgacaggcc  120
cctggacaag ggcttgagtg gatgggaggg atcatcgcta tcttcggaac agcaaactac  180
gcacagaagt tccagggcag aatcacgatt accgcggacg aatccacgag tacagcctac  240
atggagctga gcagcctgag atctgaggac acggccgtgt atttctgtgc gagaggcagt  300
ggttatcata tatcgacacc ctttgacaac tggggccagg gaaccctggt caccgtctcg  360
agtgctagca ccaagggccc cagcgtgttc cccctggccc cagcagcaa gagcaccagc  420
ggcggcacag ccgccctggg ctgcctggtg aaggactact ccccgagcc cgtgaccgtg  480
agctggaaca gcggcgcctt gaccagcggc gtgcacacct tcccgccgt gctgcagagc  540
agcggcctgt acagcctgag cagcgtggtg accgtgccca gcagcagcct gggcacccag  600
```

```
acctacatct gcaacgtgaa ccacaagccc agcaacacca aggtggacaa acgcgtggag    660
cccaagagct gcgacaagac ccacacctgc cccccctgcc ctgccccgga gctgctgggc    720
ggaccctccg tgttcctgtt ccccccaag cccaaggaca ccctcatgat cagccggacc    780
cccgaggtga cctgcgtggt ggtggacgtg agccacgagg accccgaggt gaagttcaac    840
tggtacgtgg acggcgtgga ggtgcacaac gccaagacca gccccggga ggagcagtac    900 aacagcacct accgggtggt gagcgtgctc accgtgctgc accaggactg gctgaacggc    960
aaggagtaca agtgcaaggt gagcaacaag gccctgcctg cccccatcga aagaccatc     1020 agcaaggcca agggccagcc ccgggagccc caggtgtaca ccctgccccc cagccgggag    1080
gagatgacca agaaccaggt gtccctcacc tgtctggtga agggcttcta ccccagcgac    1140
atcgccgtgg agtgggagag caacggccag cccgagaaca actacaagac cacccccct    1200 gtgctggaca gcgacggcag cttcttcctg tacagcaagc tcaccgtgga caagagccgg    1260
tggcagcagg gcaacgtgtt cagctgcagc gtgatgcacg aggccctgca caaccactac    1320
acccagaaga gcctgagcct gagccccggc aag                                 1353
```

CR6327 Heavy Chain amino acid sequence
(SEQ ID NO: 503)
EVQLVETGAEVKKPGSSVKVSCKASGGTFRTHAISWVRQAPGQGLEWMGGIIAIFGTANYA

QKFQGRITITADESTSTAYMELSSLRSEDTAVYFCARGSGYHISTPFDNWGQGTLVTVSSAST

KGPSVFPLAPSSKSTSGGTAALGCLVKDYFPEPVTVSWNSGALTSGVHTFPAVLQSSGLYSLS

SVVTVPSSSLGTQTYICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYNSTYRVVSVLTV

LHQDWLNGKEYKCKVSNKALPAPIEKTISKAKGQPREPQVYTLPPSREEMTKNQVSLTCLVK

GFYPSDIAVEWESNGQPENNYKTTPPVLDSDGSFFLYSKLTVDKSRWQQGNVFSCSVMHEAL

HNHYTQKSLSLSPGK

CR6327 VH amino acid sequence
(SEQ ID NO: 501)
EVQLVETGAEVKKPGSSVKVSCKASGGTFRTHAISWVRQAPGQGLEWMGGIIAIFGTANYA

QKFQGRITITADESTSTAYMELSSLRSEDTAVYFCARGSGYHISTPFDNWGQGTLVTVSS

CR6327 Light Chain nucleotide sequence
(SEQ ID NO: 505)
```
tcctatgtgc tgactcagcc accctcggtg tcagtggccc caggacagac ggccaggatt     60
acctgtgggg gaaacaacat tggaagtaaa ggtgtgcact ggtaccagca gaagcctggc    120
caggcccctg tgctggtcgt ctatgatgat agcgaccggc cctcagggat ccctgagcga    180
ttctctggct ccaactctgg gaacacggcc accctgacca tcagcagggt cgaagccggg    240
gatgaggccg actattactg tcaggtgtgg gatagtagta gtgatcatgt ggtattcggc    300
ggagggacca agctgaccgt cctaggtgcg gccgcaggcc agcccaaggc cgctcccagc    360
gtgaccctgt tccccccctc ctccgaggag ctgcaggcca caaggccac cctggtgtgc    420 ctcatcagcg acttctaccc tggcgccgtg accgtggcct ggaaggccga cagcagcccc    480
gtgaaggccg gcgtggagac caccaccccc agcaagcaga gcaacaacaa gtacgccgcc    540
agcagctacc tgagcctcac ccccgagcag tggaagagcc accggagcta cagctgccag    600
gtgacccacg agggcagcac cgtggagaag accgtggccc ccaccgagtg cagc          654
```

CR6327 Light Chain amino acid sequence
(SEQ ID NO: 506)
SYVLTQPPSVSVAPGQTARITCGGNNIGSKGVHWYQQKPGQAPVLVVYDDSDRPSGIPERFS

GSNSGNTATLTISRVEAGDEADYYCQVWDSSSDHVVFGGGTKLTVLGAAAGQPKAAPSVTL

-continued

FPPSSEELQANKATLVCLISDFYPGAVTVAWKADSSPVKAGVETTTPSKQSNNKYAASSYLSL

TPEQWKSHRSYSCQVTHEGSTVEKTVAPTECS

CR6327 VL amino acid sequence
(SEQ ID NO: 504)
SYVLTQPPSVSVAPGQTARITCGGNNIGSKGVHWYQQKPGQAPVLVVYDDSDRPSGIPERFS

GSNSGNTATLTISRVEAGDEADYYCQVWDSSSDHVVFGGGTKLTVLG

The CR6328 HA-specific IgG antibody includes a heavy chain variable region (SEQ ID NO: 507) encoded by the heavy chain nucleotide sequence shown in SEQ ID NO: 508 and the heavy chain amino acid sequence shown in SEQ ID NO: 509. The CR6328 HA-specific IgG antibody also includes a light chain variable region (SEQ ID NO: 510) encoded by the light chain nucleotide sequence shown in SEQ ID NO: 511 and the light chain amino acid sequence shown in SEQ ID NO: 512.

```
CR6328 Heavy Chain nucleotide sequence
                                                      (SEQ ID NO: 508)
gaggtgcagc tggtggagtc tggggctgag gtgaagaagc ctgggtcctc ggtgaaggtc    60
tcctgcaagg cttctggaca catcttcagc ggctatgcaa tcagttgggt gcgacaggcc   120
cctggacaag ggcttgagtg gatgggaggg atcatcccta tctttggtac aacaaactac   180
gcacagaagt tccagggcag agtcacgatt accgcggacc aatccacgag cacagcctac   240
atggacctga gcaacttgag atctgaggac acggccgtct attactgtgc gagagtgaaa   300
gatggatatt gtactcttac cagctgccct gtcggctggt acttcgatct ctggggccgt   360
ggcaccctgg tcactgtctc gagtgctagc accaagggcc cagcgtgtt cccctggcc   420 cccagcagca agagcaccag cggcggcaca gccgccctgg gctgcctggt gaaggactac   480
ttccccgagc ccgtgaccgt gagctggaac agcggcgcct tgaccagcgg cgtgcacacc   540
ttccccgccg tgctgcagag cagcggcctg tacagcctga gcagcgtggt gaccgtgccc   600
agcagcagcc tgggcaccca gacctacatc tgcaacgtga accacaagcc cagcaacacc   660
aaggtggaca acgcgtgga gcccaagagc tgcgacaaga cccacacctg cccccccctgc   720 cctgcccccg agctgctggg cggaccctcc gtgttcctgt tcccccccaa gcccaaggac   780
accctcatga tcagccggac ccccgaggtg acctgcgtgg tggtggacgt gagccacgag   840
gaccccgagg tgaagttcaa ctggtacgtg gacggcgtgg aggtgcacaa cgccaagacc   900 aagcccgggaggagcagta caacagcacc taccgggtgg tgagcgtgct caccgtgctg   960
caccaggact ggctgaacgg caaggagtac aagtgcaagg tgagcaacaa ggccctgcct  1020 gccccccatcg agaagaccat cagcaaggcc aagggccagc cccgggagcc ccaggtgtac  1080
accctgcccc ccagccggga ggagatgacc aagaaccagg tgtccctcac ctgtctggtg  1140
aagggcttct accccagcga catcgccgtg gagtgggaga gcaacggcca gcccgagaac  1200
aactacaaga ccacccccccc tgtgctggac agcgacggca gcttcttcct gtacagcaag  1260
ctcaccgtgg acaagagccg gtggcagcag ggcaacgtgt tcagctgcag cgtgatgcac  1320
gaggccctgc acaaccacta cacccagaag agcctgagcc tgagccccgg caag        1374

CR6328 Heavy Chain amino acid sequence
                                                      (SEQ ID NO: 509)
```
EVQLVESGAEVKKPGSSVKVSCKASGHIFSGYAISWVRQAPGQGLEWMGGIIPIFGTTNYAQ

KFQGRVTITADQSTSTAYMDLSNLRSEDTAVYYCARVKDGYCTLTSCPVGWYFDLWGRGTL

VTVSSASTKGPSVFPLAPSSKSTSGGTAALGCLVKDYFPEPVTVSWNSGALTSGVHTFPAVLQ

SSGLYSLSSVVTVPSSSLGTQTYICNVNHKPSNTKVDKRVEPKSCDKTHTCPPCPAPELLGGPS

VFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQ

```
VSLTCLVKGFYPSDIAVEWESNGQPENNYKTTPPVLDSDGSFFLYSKLTVDKSRWQQGNVFS

CSVMHEALHNHYTQKSLSLSPGK

CR6328 VH amino acid sequence
                                                    (SEQ ID NO: 507)
EVQLVESGAEVKKPGSSVKVSCKASGHIFSGYAISWVRQAPGQGLEWMGGIIPIFGTTNYAQ

KFQGRVTITADQSTSTAYMDLSNLRSEDTAVYYCARVKDGYCTLTSCPVGWYFDLWGRGTL

VTVSS

CR6328 Light Chain nucleotide sequence
                                                    (SEQ ID NO: 511)
gaaattgtga tgacgcagtc tccaggcacc ctgtctttgt ctccagggga aagagccacc    60
ctctcgtgca gggccagtca gagtgttagc agcagctact tagcctggta ccagcagaaa   120
cctggccagg ctcccaggct cctcatcttt ggtgcctcca gcagggccac tggcatccca   180
gacaggttca gtggcagtgg gtctgggaca gacttcactc tcaccatcag cagactggag   240
cctgaagatt ttgcagtgta ttactgtcag cagtatggta gctcactcac tttcggcgga   300
gggaccaagc tggagatcaa acgtgcggcc gcacccagcg tgttcatctt ccccccctcc   360
gacgagcagc tgaagagcgg caccgccagc gtggtgtgcc tgctgaacaa cttctacccc   420
cgggaggcca aggtgcagtg gaaggtggac aacgccctgc agagcggcaa cagccaggag   480
agcgtgaccg agcaggacag caaggactcc acctacagcc tgagcagcac cctcaccctg   540
agcaaggccg actacgagaa gcacaaggtg tacgcctgcg aggtgaccca ccagggcctg   600
agcagccccg tgaccaagag cttcaaccgg ggcgagtgt                          639

CR6328 Light Chain amino acid sequence
                                                    (SEQ ID NO: 512)
EIVMTQSPGTLSLSPGERATLSCRASQSVSSSYLAWYQQKPGQAPRLLIFGASSRATGIPDRFS

GSGSGTDFTLTISRLEPEDFAVYYCQQYGSSLTFGGGTKLEIKRAAAPSVFIFPPSDEQLKSGT

ASVVCLLNNFYPREAKVQWKVDNALQSGNSQESVTEQDSKDSTYSLSSTLTLSKADYEKHK

VYACEVTHQGLSSPVTKSFNRGEC

CR6328 VL amino acid sequence
                                                    (SEQ ID NO: 510)
EIVMTQSPGTLSLSPGERATLSCRASQSVSSSYLAWYQQKPGQAPRLLIFGASSRATGIPDRFS

GSGSGTDFTLTISRLEPEDFAVYYCQQYGSSLTFGGGTKLEIKR
```

The CR6329 HA-specific IgG antibody includes a heavy chain variable region (SEQ ID NO: 513) encoded by the heavy chain nucleotide sequence shown in SEQ ID NO: 514 and the heavy chain amino acid sequence shown in SEQ ID NO: 515. The CR6329 HA-specific IgG antibody also includes a light chain variable region (SEQ ID NO: 516) encoded by the light chain nucleotide sequence shown in SEQ ID NO: 517 and the light chain amino acid sequence shown in SEQ ID NO: 518.

```
CR6329 Heavy Chain nucleotide sequence
                                                    (SEQ ID NO: 514)
gaggtccagc tggtacagtc tggggctgag gttaagaagc ctgggtcctc ggtgaaggtc    60
tcctgcaagg cttctggagg catcttcaga agcaattcta tcagttgggt gcgacaggcc   120
cctgggcaag gcttgagtg gatgggaggg atcttcgctc ttttcggaac aacagactac   180
gcgcagaagt tccagggcag agtcacgatt accgcggacg aatcttcgac cacagtctac   240
ctggagctga gtagcctgac atctgaggac acggccgttt attactgtgc gagaggcagt   300
ggctacacca cacgcaacta ctttgactac tggggccagg gcaccctggt caccgtctcg   360
agtgctagca ccaagggccc cagcgtgttc ccctggccc ccagcagcaa gagcaccagc   420
ggcggcacag ccgccctggg ctgcctggta aaggactact cccccgagcc cgtgaccgtg   480
agctggaaca gcggcgcctt gaccagcggc gtgcacacct tccccgccgt gctgcagagc   540
```

-continued

```
agcggcctgt acagcctgag cagcgtggtg accgtgccca gcagcagcct gggcacccag    600
acctacatct gcaacgtgaa ccacaagccc agcaacacca aggtggacaa gcgtggag     660
cccaagagct gcgacaagac ccacacctgc cccccctgcc ctgccccga gctgctgggc    720
ggaccctccg tgttcctgtt cccccccaag cccaaggaca ccctcatgat cagccggacc   780
cccgaggtga cctgcgtggt ggtggacgtg agccacgagg accccgaggt gaagttcaac   840
tggtacgtgg acggcgtgga ggtgcacaac gccaagacca gccccggga ggagcagtac    900
aacagcacct accgggtggt gagcgtgctc accgtgctgc accaggactg gctgaacggc   960
aaggagtaca gtgcaaggt gagcaacaag gccctgcctg cccccatcga gaagaccatc    1020
agcaaggcca agggccagcc ccgggagccc caggtgtaca ccctgccccc cagccgggag   1080
gagatgacca gaaccaggt gtccctcacc tgtctggtga agggcttcta ccccagcgac    1140
atcgccgtgg agtgggagag caacggccag cccgagaaca actacaagac cacccccct    1200
gtgctggaca cgacggcag cttcttcctg tacagcaagc tcaccgtgga caagagccgg    1260
tggcagcagg gcaacgtgtt cagctgcagc gtgatgcacg aggccctgca caaccactac   1320
acccagaaga gcctgagcct gagccccggc aag                                1353
```

CR6329 Heavy Chain amino acid sequence (SEQ ED NO: 515)

EVQLVQSGAEVKKPGSSVKVSCKASGGIFRSNSISWVRQAPGQGLEWMGGIFALFGTTDYAQ

KFQGRVTITADESSTTVYLELSSLTSEDTAVYYCARGSGYTTRNYFDYWGQGTLVTVSSAST

KGPSVFPLAPSSKSTSGGTAALGCLVKDYFPEPVTVSWNSGALTSGVHTFPAVLQSSGLYSLS

SVVTVPSSSLGTQTYICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYNSTYRVVSVLTV

LHQDWLNGKEYKCKVSNKALPAPIEKTISKAKGQPREPQVYTLPPSREEMTKNQVSLTCLVK

GFYPSDIAVEWESNGQPENNYKTTPPVLDSDGSFFLYSKLTVDKSRWQQGNVFSCSVMHEAL

HNHYTQKSLSLSPGK

CR6329 VH amino acid sequence (SEQ ID NO: 513)

EVQLVQSGAEVKKPGSSVKVSCKASGGIFRSNSISWVRQAPGQGLEWMGGIFALFGTTDYAQ

KFQGRVTITADESSTTVYLELSSLTSEDTAVYYCARGSGYTTRNYFDYWGQGTLVTVSS

CR6329 Light Chain nucleotide sequence (SEQ ID NO: 517)

```
gaaattgtgc tgactcagtc tccaggcacc ctgtctttgt ctccagggga agagccaca     60
ctctcctgca gggccagtca gagtgttagc agcaactact taggctggta ccagcagaaa   120
cctggccagg ctcccaggct cctgatctat ggtgcatcca gcagggccag tggcatccca   180
gacaggttca gtggcggtgg gtctgggaca gacttcactc tcaccatcag cagactggag   240
cctgaagatt ttgcagtgta ttactgtcag cagtatggta gctcacccct cactttcggc   300
ggagggacca aggtggagat caaacgtgcg gccgcaggcc agcccaaggc cgctcccagc   360
gtgaccctgt ccccccctc ctccgaggag ctgcaggcca caaggccac cctggtgtgc    420
ctcatcagcg acttctaccc tggcgccgtg accgtggcct ggaaggccga cagcagcccc   480
gtgaaggccg gcgtggagac caccaccccc agcaagcaga gcaacaacaa gtacgccgcc   540
agcagctacc tgagcctcac cccgagcag tggaagagcc accggagcta cagctgccag   600
gtgacccacg agggcagcac cgtggagaag accgtggccc ccaccgagtg cagc         654
```

CR6329 Light Chain amino acid sequence (SEQ ID NO: 518)
EIVLTQSPGTLSLSPGERATLSCRASQSVSSNYLGWYQQKPGQAPRLLIYGASSRASGIPDRFS

GGGSGTDFTLTISRLEPEDFAVYYCQQYGSSPLTFGGGTKVEIKRAAAGQPKAAPSVTLFPPSS

EELQANKATLVCLISDFYPGAVTVAWKADSSPVKAGVETTTPSKQSNNKYAASSYLSLTPEQ

WKSHRSYSCQVTHEGSTVEKTVAPTECS

CR6329 VL amino acid sequence
(SEQ ID NO: 516)
EIVLTQSPGTLSLSPGERATLSCRASQSVSSNYLGWYQQKPGQAPRLLIYGASSRASGIPDRFS

GGGSGTDFTLTISRLEPEDFAVYYCQQYGSSPLTFGGGTKVEIKR

The CR6331 HA-specific IgG antibody includes a heavy chain variable region (SEQ ID NO: 519) encoded by the heavy chain nucleotide sequence shown in SEQ ID NO: 520 and the heavy chain amino acid sequence shown in SEQ ID NO: 521. The CR6331 HA-specific IgG antibody also includes a light chain variable region (SEQ ID NO: 522) encoded by the light chain nucleotide sequence shown in SEQ ID NO: 523 and the light chain amino acid sequence shown in SEQ ID NO: 524.

```
CR6331 Heavy Chain nucleotide sequence
                                                    (SEQ ID NO: 520)
gaggtgcagc tggtggagtc tggggctgag gtgaagaagc ctgggtcctc ggtgaaggtc    60
tcctgcaagg cttctggagg caccttcagc agctatgcta tcagctgggt gcgacaggcc   120
cctggacaag ggcttgagtg gatgggaggg atcatcggta tgttcggtac agcaaactac   180
gcacagaagt tccagggcag agtcacgatt accgcggacg aatttacgag cacagcctac   240
atggagctga gcagcctgag atctgaggac acggccgtgt attactgtgc gagaggaaat   300
tattactatg agagtagtct cgactactgg ggccagggaa ccctggtcac cgtctcgagt   360
gctagcacca agggcccag cgtgttcccc ctggcccca gcagcaagag caccagcggc    420
ggcacagccg ccctgggctg cctggtgaag gactacttcc ccgagcccgt gaccgtgagc   480
tggaacagcg gcgccttgac cagcggcgtg cacaccttcc ccgccgtgct gcagagcagc   540
ggcctgtaca gcctgagcag cgtggtgacc gtgcccagca gcagcctggg cacccagacc   600
tacatctgca acgtgaacca caagcccagc aacaccaagg tggacaaacg cgtggagccc   660
aagagctgcg acaagaccca cacctgcccc cctgccctg ccccgagct gctgggcgga   720 ccctccgtgt tcctgttccc ccccaagccc aaggacaccc tcatgatcag ccggacccc   780 gaggtgacct gcgtggtggt ggacgtgagc cacgaggacc ccgaggtgaa gttcaactgg   840
tacgtggacg gcgtggaggt gcacaacgcc aagaccaagc ccggggagga gcagtacaac   900
agcacctacc gggtggtgag cgtgctcacc gtgctgcacc aggactggct gaacggcaag   960
gagtacaagt gcaaggtgag caacaaggcc ctgcctgccc ccatcgagaa gaccatcagc  1020
aaggccaagg gccagccccg ggagccccag gtgtacaccc tgccccccag ccgggaggag  1080
atgaccaaga accaggtgtc cctcacctgt ctggtgaagg gcttctaccc cagcgacatc  1140
gccgtggagt gggagagcaa cggccagccc gagaacaact acaagaccac ccccccctgtg  1200 ctggacagcg acggcagctt cttcctgtac agcaagctca ccgtggacaa gagccggtgg  1260
cagcagggca acgtgttcag ctgcagcgtg atgcacgagg ccctgcacaa ccactacacc  1320
cagaagagcc tgagcctgag ccccggcaag                                   1350

CR6331 Heavy Chain amino acid sequence
                                                    (SEQ ID NO: 521)
EVQLVESGAEVKKPGSSVKVSCKASGGTFSSYAISWVRQAPGQGLEWMGGIIGMFGTANYA

QKFQGRVTITADEFTSTAYMELSSLRSEDTAVYYCARGNYYYESSLDYWGQGTLVTVSSAST

KGPSVFPLAPSSKSTSGGTAALGCLVKDYFPEPVTVSWNSGALTSGVHTFPAVLQSSGLYSLS

SVVTVPSSSLGTQTYICNVNHKPSNTKVDKRVEPKSCDKTHTCPPCPAPELLGGPSVFLFPPKP
```

KDTLMISRTPEVTCVVVDVSHEDPEVKFNWYVDGVEVHNAKTKPREEQYNSTYRVVSVLTV

LHQDWLNGKEYKCKVSNKALPAPIEKTISKAKGQPREPQVYTLPPSREEMTKNQVSLTCLVK

GFYPSDIAVEWESNGQPENNYKTTPPVLDSDGSFFLYSKLTVDKSRWQQGNVFSCSVMHEAL

HNHYTQKSLSLSPGK

CR6331 VH amino acid sequence
(SEQ ID NO: 519)
EVQLVESGAEVKKPGSSVKVSCKASGGTFSSYAISWVRQAPGQGLEWMGGIIGMFGTANYA

QKFQGRVTITADEFTSTAYMELSSLRSEDTAVYYCARGNYYYESSLDYWGQGTLVTVSS

```
CR6331 Light Chain nucleotide sequence
                                                         (SEQ ID NO: 523)
cagtctgtcg tgacgcagcc gccctcggtg tcagtggccc caggacagac ggccaggatt    60
acctgtgggg gaaacaacat tggaagtaaa agtgtgcact ggtaccagca gaagccaggc   120
caggcccctg tgctggtcgt ctatgatgat agcgaccggc cctcagggat ccctgagcga   180
ttctctggct ccaactctgg gaacacggcc accctgacca tcagcagggt cgaagccggg   240
gatgaggccg actattactg tcaggtgtgg gatagtagta gtgatcatta tgtcttcgga   300
actgggacca aggtcaccgt cctaggtgcg gccgcaggcc agcccaaggc cgctcccagc   360
gtgaccctgt tcccccctc ctccgaggag ctgcaggcca acaaggccac cctggtgtgc    420
ctcatcagcg acttctaccc tggcgccgtg accgtggcct ggaaggccga cagcagcccc   480
gtgaaggccg gcgtggagac caccacccc agcaagcaga gcaacaacaa gtacgccgcc    540
agcagctacc tgagcctcac ccccgagcag tggaagagcc accggagcta cagctgccag   600
gtgacccacg agggcagcac cgtggagaag accgtggccc ccaccgagtg cagc         654
```

CR6331 Light Chain amino acid sequence
(SEQ ID NO: 524)
QSVVTQPPSVSVAPGQTARITCGGNNIGSKSVHWYQQKPGQAPVLVVYDDSDRPSGIPERFS

GSNSGNTATLTISRVEAGDEADYYCQVWDSSSDHYVFGTGTKVTVLGAAAGQPKAAPSVTL

FPPSSEELQANKATLVCLISDFYPGAVTVAWKADSSPVKAGVETTTPSKQSNNKYAASSYLSL

TPEQWKSHRSYSCQVTHEGSTVEKTVAPTECS

CR6331 VL amino acid sequence
(SEQ ID NO: 522)
QSVVTQPPSVSVAPGQTARITCGGNNIGSKSVHWYQQKPGQAPVLVVYDDSDRPSGIPERFS

GSNSGNTATLTISRVEAGDEADYYCQVWDSSSDHYVFGTGTKVTVLG

The CR6332 HA-specific IgG antibody includes a heavy chain variable region (SEQ ID NO: 525) encoded by the heavy chain nucleotide sequence shown in SEQ ID NO: 526 and the heavy chain amino acid sequence shown in SEQ ID NO: 527. The CR6332 HA-specific IgG antibody also includes a light chain variable region (SEQ ID NO: 528) encoded by the light chain nucleotide sequence shown in SEQ ID NO: 529 and the light chain amino acid sequence shown in SEQ ID NO: 530.

```
CR6332 Heavy Chain nucleotide sequence
                                                         (SEQ ID NO: 526)
caggtgcagc tggtgcagtc tggggctgag gtgaagaagc ctgggtcctc ggtaaaggtc    60
tcctgcaagg cttctggagg ccccttccgc aattttgcta tcaactgggt gcgacaggcc   120
cctggacaag gcttgagtg gatgggaggg atcatcgctg tctttgggac gacaaagtac    180
gcacataagt tccagggcag agtcaccatc accgcggacg actccacaaa tacagcttac   240
atggagctgg gcagcctgaa atctgaggac acggccgtgt attactgtgc gagaggtccc   300
cactactact cctcctacat ggacgtctgg ggcgaaggga ccacggtcac cgtctcgagt   360
gctagcacca agggcccag cgtgttcccc ctggccccca gcagcaagag caccagcggc   420
ggcacagccg ccctgggctg cctggtgaag gactacttcc ccgagcccgt gaccgtgagc   480
```

-continued

```
tggaacagcg gcgccttgac cagcggcgtg cacaccttcc ccgccgtgct gcagagcagc      540
ggcctgtaca gcctgagcag cgtggtgacc gtgcccagca gcagcctggg cacccagacc      600
tacatctgca acgtgaacca caagcccagc aacaccaagg tggacaaacg cgtggagccc      660
aagagctgcg acaagaccca cacctgcccc cctgccctg ccccgagct gctgggcgga       720 ccctccgtgt tcctgttccc ccccaagccc aaggacaccc tcatgatcag ccggaccccc     780
gaggtgacct gcgtggtggt ggacgtgagc acgaggacc ccgaggtgaa gttcaactgg      840
tacgtggacg gcgtggaggt gcacaacgcc aagaccaagc ccgggagga gcagtacaac      900 agcacctacc gggtggtgag cgtgctcacc gtgctgcacc aggactggct gaacggcaag     960
gagtacaagt gcaaggtgag caacaaggcc ctgcctgccc ccatcgagaa gaccatcagc    1020
aaggccaagg gccagccccg ggagcccag gtgtacaccc tgcccccag ccgggaggag      1080 atgaccaaga accaggtgtc cctcacctgt ctggtgaagg gcttctaccc cagcgacatc    1140
gccgtggagt gggagagcaa cggccagccc gagaacaact acaagaccac ccccctgtg     1200 ctggacagcg acggcagctt cttcctgtac agcaagctca ccgtggacaa gagccggtgg   1260
cagcagggca acgtgttcag ctgcagcgtg atgcacgagg ccctgcacaa ccactacacc   1320
cagaagagcc tgagcctgag ccccggcaag                                     1350
```

CR6332 Heavy Chain amino acid sequence (SEQ ID NO: 527)

QVQLVQSGAEVKKPGSSVKVSCKASGGPFRNFAINWVRQAPGQGLEWMGGIIAVFGTTKYA

HKFQGRVTITADDSTNTAYMELGSLKSEDTAVYYCARGPHYYSSYMDVWGEGTTVTVSSAS

TKGPSVFPLAPSSKSTSGGTAALGCLVKDYFPEPVTVSWNSGALTSGVHTFPAVLQSSGLYSL

SSVVTVPSSSLGTQTYICNVNHKPSNTKVDKRVEPKSCDKTHTCPPCPAPELLGGPSVFLFPPK

PKDTLMISRTPEVTCVVVDVSHEDPEVKFNWYVDGVEVHNAKTKPREEQYNSTYRVVSVLT

VLHQDWLNGKEYKCKVSNKALPAPIEKTISKAKGQPREPQVYTLPPSREEMTKNQVSLTCLV

KGFYPSDIAVEWESNGQPENNYKTTPPVLDSDGSFFLYSKLTVDKSRWQQGNVFSCSVMHE

ALHNHYTQKSLSLSPGK

CR6332 VH amino acid sequence (SEQ ID NO: 525)

QVQLVQSGAEVKKPGSSVKVSCKASGGPFRNFAINWVRQAPGQGLEWMGGIIAVFGTTKYA

HKFQGRVTITADDSTNTAYMELGSLKSEDTAVYYCARGPHYYSSYMDVWGEGTTVTVSS

CR6332 Light Chain nucleotide sequence (SEQ ID NO: 529)

```
gacatccagt tgacccagtc tccatcctcc ctgtctgcat ctgtaggaga cagagtcacc      60
atcacttgcc gggcgagtca gggcattagc acttatttag cctggtatca gcagaaaccc    120
gggaaagttc ctaaactcct gatctatgct gcatccactt tgcaatcagg gtcccatct    180 cggttcagtg gcagtggatc tgggacagat ttcactctca ccatcagcag cctgcagcct    240
gaagatgttg caacttatta ctgtcaaaag tataacagtg ccccttcttt cggccctggg    300
accaaagtgg atatcaaacg tgcggccgca cccagcgtgt tcatcttccc ccctccgac     360 gagcagctga agagcggcac cgccagcgtg gtgtgcctgc tgaacaactt ctaccccgg     420 gaggccaagg tgcagtggaa ggtggacaac gccctgcaga gcggcaacag ccaggagagc    480
gtgaccgagc aggacagcaa ggactccacc tacagcctga gcagcaccct caccctgagc    540
aaggccgact acgagaagca caaggtgtac gcctgcgagg tgacccacca gggcctgagc    600
agccccgtga ccaagagctt caaccggggc gagtgt                              636
```

CR6332 Light Chain amino acid sequence

```
                                                        (SEQ ID NO: 530)
DIQLTQSPSSLSASVGDRVTITCRASQGISTYLAWYQQKPGKVPKLLIYAASTLQSGVPSRFSG

SGSGTDFTLTISSLQPEDVATYYCQKYNSAPSFGPGTKVDIKRAAAPSVFIFPPSDEQLKSGTA

SVVCLLNNFYPREAKVQWKVDNALQSGNSQESVTEQDSKDSTYSLSSTLTLSKADYEKHKV

YACEVTHQGLSSPVTKSFNRGEC

CR6332 VL amino acid sequence
                                                        (SEQ ID NO: 528)
DIQLTQSPSSLSASVGDRVTITCRASQGISTYLAWYQQKPGKVPKLLIYAASTLQSGVPSRFSG

SGSGTDFTLTISSLQPEDVATYYCQKYNSAPSFGPGTKVDIKR
```

The CR6334 HA-specific IgG antibody includes a heavy chain variable region (SEQ ID NO: 531) encoded by the heavy chain nucleotide sequence shown in SEQ ID NO: 532 and the heavy chain amino acid sequence shown in SEQ ID NO: 533. The CR6334 HA-specific IgG antibody also includes a light chain variable region (SEQ ID NO: 534) encoded by the light chain nucleotide sequence shown in SEQ ID NO: 535 and the light chain amino acid sequence shown in SEQ ID NO: 536.

```
CR6334 Heavy Chain nucleotide sequence
                                                        (SEQ ID NO: 532)
gaggtgcagc tggtggagac tggggctgag gtgaagaagc ctgggtcctc ggtgaaggtc     60
ccctgcaaat cttctggaag ccccttcagg agtaatgctg tcagctgggt gcgacaggcc    120
cccggacaag ggcttgagtg ggtgggagga atcctcggtg tctttggttc accaagctac    180
gcacagaagt tccagggcag agtcacgatt accgcggacg aatccaccaa cacagtccac    240
atggagctga gaggtttgag atctgaggac acggccgtgt attattgtgc gagaggtcct    300
acctactact actcctacat ggacgtctgg ggcaaaggga ccacggtcac cgtctcgagt    360
gctagcacca agggcccag cgtgttcccc ctggccccca gcagcaagag caccagcggc    420
ggcacagccg ccctgggctg cctggtgaag gactacttcc ccgagcccgt gaccgtgagc    480
tggaacagcg gcgccttgac cagcggcgtg cacaccttcc ccgccgtgct gcagagcagc    540
ggcctgtaca gcctgagcag cgtggtgacc gtgcccagca gcagcctggg cacccagacc    600
tacatctgca acgtgaacca caagcccagc aacaccaagg tggacaaacg cgtggagccc    660
aagagctgcg acaagaccca cacctgcccc cctgccctg ccccgagct gctgggcgga    720 ccctccgtgt tcctgttccc ccccaagccc aaggacaccc tcatgatcag ccggaccccc    780
gaggtgacct gcgtggtggt ggacgtgagc cacgaggacc ccgaggtgaa gttcaactgg    840
tacgtggacg gcgtggaggt gcacaacgcc aagaccaagc ccgcggagga gcagtacaac    900
agcacctacc gggtggtgag cgtgctcacc gtgctgcacc aggactggct gaacggcaag    960
gagtacaagt gcaaggtgag caacaaggcc ctgcctgccc ccatcgagaa gaccatcagc   1020
aaggccaagg gccagccccg ggagccccag gtgtacaccc tgcccccag ccgggaggag   1080 atgaccaaga accaggtgtc cctcacctgt ctggtgaagg gcttctaccc cagcgacatc   1140
gccgtggagt gggagagcaa cggccagccc gagaacaact acaagaccac cccccctgtg   1200
ctggacagcg acggcagctt cttcctgtac agcaagctca ccgtggacaa gagccggtgg   1260
cagcagggca acgtgttcag ctgcagcgtg atgcacgagg ccctgcacaa ccactacacc   1320
cagaagagcc tgagcctgag ccccggcaag                                    1350

CR6334 Heavy Chain amino acid sequence
                                                        (SEQ ID NO: 533)
EVQLVETGAEVKKPGSSVKVPCKSSGSPFRSNAVSWVRQAPGQGLEWVGGILGVFGSPSYA

QKFQGRVTITADESTNTVHMELRGLRSEDTAVYYCARGPTYYYSYMDVWGKGTTVTVSSA

STKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKRVEPKSCDKTHTCPPCPAPELLGGPSVFLFPP
```

-continued

KPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRWQQGNVFSCSVMH

EALHNHYTQKSLSLSPGK

CR6334 VH amino acid sequence
(SEQ ID NO: 531)
EVQLVETGAEVKKPGSSVKVPCKSSGSPFRSNAVSWVRQAPGQGLEWVGGILGVFGSPSYA

QKFQGRVTITADESTNTVHMELRGLRSEDTAVYYCARGPTYYYSYMDVWGKGTTVTVSS

CR6334 Light Chain nucleotide sequence
(SEQ ID NO: 535)
```
tcctatgtgc tgactcagcc accctcggag tcagtggccc caggacagac ggccaggatt    60
acctgtgggg gaaataacat tggaagaaat agtgtgcact ggtatcagca gaagccaggc   120
caggcccctg tgctggtcgt gtatgatgat agcgaccggc cctcagggat ccctgagcga   180
ttttctggct ccaagtctgg gaacacggcc accctgatta tcagcagggt cgaagtcggg   240
gatgaggccg actactactg tcaggtgtgg catagtagta gtgatcatta tgtcttcgga   300
actgggacca aggtcaccgt cctaggtgcg gccgcaggcc agcccaaggc cgctcccagc   360
gtgaccctgt tcccccctc ctccgaggag ctgcaggcca acaaggccac cctggtgtgc   420
ctcatcagcg acttctaccc tggcgccgtg accgtggcct ggaaggccga cagcagcccc   480
gtgaaggccg gcgtggagac caccaccccc agcaagcaga gcaacaacaa gtacgccgcc   540
agcagctacc tgagcctcac ccccgagcag tggaagagcc accggagcta cagctgccag   600
gtgacccacg agggcagcac cgtggagaag accgtggccc ccaccgagtg cagc         654
```

CR6334 Light Chain amino acid sequence
(SEQ ID NO: 536)
SYVLTQPPSESVAPGQTARITCGGNNIGRNSVHWYQQKPGQAPVLVVYDDSDRPSGIPERFSG

SKSGNTATLIISRVEVGDEADYYCQVWHSSSDHYVFGTGTKVTVLGAAAGQPKAAPSVTLFP

PSSEELQANKATLVCLISDFYPGAVTVAWKADSSPVKAGVETTTPSKQSNNKYAASSYLSLT

PEQWKSHRSYSCQVTHEGSTVEKTVAPTECS

CR6334 VL amino acid sequence
(SEQ ID NO: 534)
SYVLTQPPSESVAPGQTARITCGGNNIGRNSVHWYQQKPGQAPVLVVYDDSDRPSGIPERFSG

SKSGNTATLIISRVEVGDEADYYCQVWHSSSDHYVFGTGTKVTVLG

The CR6336 HA-specific IgG antibody includes a heavy chain variable region (SEQ ID NO: 537) encoded by the heavy chain nucleotide sequence shown in SEQ ID NO: 538 and the heavy chain amino acid sequence shown in SEQ ID NO: 539. The CR6336 HA-specific IgG antibody also includes a light chain variable region (SEQ ID NO: 540) encoded by the light chain nucleotide sequence shown in SEQ ID NO: 541 and the light chain amino acid sequence shown in SEQ ID NO: 542.

CR6336 Heavy Chain nucleotide sequence
(SEQ ID NO: 538)
```
cagatgcagc tggtacaatc tggagctgag gtgaagaagc ctgggtcctc ggtgaaggtc    60
tcctgcaagg cttctggagg caccttcagc agctatgcta tcagctgggt gcgacaggcc   120
cctggacaag gcttgagtg gatgggaggg atcttcggta tgtttgggac agcaaactac   180
gcgcagaagt tccagggcag agtcacgatt accgcggacg aattcacgag cgcggcctac   240
atggagctga gcagcctggg atctgaggac acggccatgt attactgtgc gaggtctagt   300
ggttattacc cccaatactt ccaggactgg ggccagggca cctggtcac cgtctcgagt   360 gctagcacca agggcccag cgtgttcccc ctggccccca gcagcaagag caccagcggc   420
ggcacagccg ccctgggctg cctggtgaag gactacttcc ccgagcccgt gaccgtgagc   480
```

```
tggaacagcg gcgccttgac cagcggcgtg cacaccttcc ccgccgtgct gcagagcagc    540
ggcctgtaca gcctgagcag cgtggtgacc gtgcccagca gcagcctggg cacccagacc    600
tacatctgca acgtgaacca caagcccagc aacaccaagg tggacaaacg cgtggagccc    660
aagagctgcg acaagaccca cacctgcccc cctgccctg cccccgagct gctgggcgga    720
ccctccgtgt tcctgttccc ccccaagccc aaggacaccc tcatgatcag ccggaccccc    780
gaggtgacct gcgtggtggt ggacgtgagc acgaggacc ccgaggtgaa gttcaactgg    840
tacgtggacg gcgtggaggt gcacaacgcc aagaccaagc ccgggagga gcagtacaac    900 agcacctacc gggtggtgag cgtgctcacc gtgctgcacc aggactggct gaacggcaag    960
gagtacaagt gcaaggtgag caacaaggcc ctgcctgccc ccatcgagaa gaccatcagc   1020
aaggccaagg gccagccccg ggagccccag gtgtacaccc tgccccccag ccgggaggag   1080
atgaccaaga accaggtgtc cctcacctgt ctggtgaagg gcttctaccc cagcgacatc   1140
gccgtggagt gggagagcaa cggccagccc gagaacaact acaagaccac ccccctgtg    1200 ctggacagcg acggcagctt cttcctgtac agcaagctca ccgtggacaa gagccggtgg   1260
cagcagggca acgtgttcag ctgcagcgtg atgcacgagg ccctgcacaa ccactacacc   1320
cagaagagcc tgagcctgag ccccggcaag                                    1350
```

CR6336 Heavy Chain amino acid sequence  
(SEQ ID NO: 539)  
QMQLVQSGAEVKKPGSSVKVSCKASGGTFSSYAISWVRQAPGQGLEWMGGIFGMFGTANY

AQKFQGRVTITADEFTSAAYMELSSLGSEDTAMYYCARSSGYYPQYFQDWGQGTLVTVSSA

STKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRWQQGNVFSCSVMH

EALHNHYTQKSLSLSPGK

CR6336 VH amino acid sequence  
(SEQ ID NO: 537)  
QMQLVQSGAEVKKPGSSVKVSCKASGGTFSSYAISWVRQAPGQGLEWMGGIFGMFGTANY

AQKFQGRVTITADEFTSAAYMELSSLGSEDTAMYYCARSSGYYPQYFQDWGQGTLVTVSS

CR6336 Light Chain nucleotide sequence  
(SEQ ID NO: 541)  
```
gaaattgtga tgacacagtc tccaggcacc ctgtctttgt ctccagggca aagagccacc     60
ctctcctgca gggccagtca gagtgttagc agcagctact tagcctggta ccagcagaaa    120
cctggccagg ctcccagact cctcatgtat ggtgcatcca gcagggccac tggcatccca    180
gacaggttca gtggcagtgg gtctgggaca gacttcactc tcaccatcag cagactggag    240
cctgaagatt ttgcagtgta ttactgtcag cagtatggta gctcatcgct cactttcggc    300
ggagggacca agctggagat caaacgtgcg ccgcacccca gcgtgttcat cttccccccc    360
tccgacgagc agctgaagag cggcaccgcc agcgtggtgt gcctgctgaa caacttctac    420
ccccgggagg ccaaggtgca gtggaaggtg gacaacgccc tgcagagcgg caacagccag    480
gagagcgtga ccgagcagga cagcaaggac tccacctaca gcctgagcag caccctcacc    540
ctgagcaagg ccgactacga gaagcacaag gtgtacgcct gcgaggtgac ccaccagggc    600
ctgagcagcc ccgtgaccaa gagcttcaac cggggcgagt gt                       642
```

CR6336 Light Chain amino acid sequence

-continued

```
                                                        (SEQ ID NO: 542)
EIVMTQSPGTLSLSPGQRATLSCRASQSVSSSYLAWYQQKPGQAPRLLMYGASSRATGIPDRF

SGSGSGTDFTLTISRLEPEDFAVYYCQQYGSSSLTFGGGTKLEIKRAAAPSVFIFPPSDEQLKSG

TASVVCLLNNFYPREAKVQWKVDNALQSGNSQESVTEQDSKDSTYSLSSTLTLSKADYEKH

KVYACEVTHQGLSSPVTKSFNRGEC

CR6336 VL amino acid sequence
                                                        (SEQ ID NO: 540)
EIVMTQSPGTLSLSPGQRATLSCRASQSVSSSYLAWYQQKPGQAPRLLMYGASSRATGIPDRF

SGSGSGTDFTLTISRLEPEDFAVYYCQQYGSSSLTFGGGTKLEIKR
```

The CR6339 HA-specific IgG antibody includes a heavy chain variable region (SEQ ID NO: 543) encoded by the heavy chain nucleotide sequence shown in SEQ ID NO: 545 and the heavy chain amino acid sequence shown in SEQ ID NO: 546. The CR6339 HA-specific IgG antibody also includes a light chain variable region (SEQ ID NO: 547) encoded by the light chain nucleotide sequence shown in SEQ ID NO: 548 and the light chain amino acid sequence shown in SEQ ID NO: 549.

```
CR6339 Heavy Chain nucleotide sequence
                                                        (SEQ ID NO: 545)
gaggtgcagc tggtggagtc cggggctgag gtgaagaagc ctgggtcctc ggtgaaggtc    60
tcctgcaagg cttctggagg catcttcaac agttatgcta tcagctgggt gcgacaggcc   120
cctggacaag ggcttgagtg gatgggaggc atcatcgcta tctttcatac accaaagtac   180
gcacagaagt tccagggcag agtcacgatt accgcggacg aatccacgaa cacagcctac   240
atggaactga aagcctgaa atctgaggac acggccctgt attactgtgc gagagggtcc   300
acttacgatt tttcgagtgg ccttgactac tggggccagg aaccctggt caccgtctcg   360 agtgctagca ccaagggccc cagcgtgttc ccctggccc ccagcagcaa gagcaccagc   420
ggcggcacag ccgccctggg ctgcctggtg aaggactact cccccgagcc cgtgaccgtg   480
agctggaaca gcggcgcctt gaccagcggc gtgcacacct ccccgccgt gctgcagagc   540 agcggcctgt acagcctgag cagcgtggtg accgtgccca gcagcagcct gggcacccag   600
acctacatct gcaacgtgaa ccacaagccc agcaacacca aggtggacaa gcgtgtggag   660
cccaagagct gcgacaagac ccacacctgc cccccctgcc ctgccccga gctgctgggc   720 ggaccctccg tgttcctgtt ccccccaag cccaaggaca ccctcatgat cagccggacc   780
cccgaggtga cctgcgtggt ggtggacgtg agccacgagg accccgaggt gaagttcaac   840
tggtacgtgg acggcgtgga ggtgcacaac gccaagacca gccccggga ggagcagtac   900 aacagcacct accgggtggt gagcgtgctc accgtgctgc accaggactg gctgaacggc   960
aaggagtaca agtgcaaggt gagcaacaag gccctgcctg ccccatcga aagaccatc   1020 agcaaggcca agggccagcc ccggagcc caggtgtaca ccctgccccc cagccgggag  1080
gagatgacca gaaccaggt gtccctcacc tgtctggtga agggcttcta tcccagcgac  1140
atcgccgtgg agtgggagag caacggccag cccgagaaca actacaagac cacccccct   1200 gtgctggaca gcgacggcag cttcttcctg tacagcaagc tcaccgtgga caagagccgg   1260
tggcagcagg gcaacgtgtt cagctgcagc gtgatgcacg aggccctgca caaccactac   1320
acccagaaga gcctgagcct gagccccggc aag                                1353

CR6339 Heavy Chain amino acid sequence
                                                        (SEQ ID NO: 546)
EVQLVESGAEVKKPGSSVKVSCKASGGIFNSYAISWVRQAPGQGLEWMGGIIAIFHTPKYAQ

KFQGRVTITADESTNTAYMELRSLKSEDTALYYCARGSTYDFSSGLDYWGQGTLVTVSSAST

KGPSVFPLAPSSKSTSGGTAALGCLVKDYFPEPVTVSWNSGALTSGVHTFPAVLQSSGLYSLS

SVVTVPSSSLGTQTYICNVNHKPSNTKVDKRVEPKSCDKTHTCPPCPAPELLGGPSVFLFPPKP
```

```
KDTLMISRTPEVTCVVVDVSHEDPEVKFNWYVDGVEVHNAKTKPREEQYNSTYRVVSVLTV

LHQDWLNGKEYKCKVSNKALPAPIEKTISKAKGQPREPQVYTLPPSREEMTKNQVSLTCLVK

GFYPSDIAVEWESNGQPENNYKTTPPVLDSDGSFFLYSKLTVDKSR

WQQGNVFSCSVMHEALHNHYTQKSLSLSPGK

CR6339 VH amino acid sequence
                                              (SEQ ID NO: 543)
EVQLVESGAEVKKPGSSVKVSCKASGGIFNSYAISWVRQAPGQGLEWMGGIIAIFHTPKYAQ

KFQGRVTITADESTNTAYMELRSLKSEDTALYYCARGSTYDFSSGLDYWGQGTLVTVSS

CR6339 Light Chain nucleotide sequence
                                              (SEQ ID NO: 548)
caggcagggc tgactcagcc accctcggtg tcagtggccc caggacagac ggccaggatt    60
acctgtgggg gaaacaacat tggaagtaaa agtgtgcact ggtaccagca gaagccaggc   120
caggcccctg tcctagtcgt ctatgatgat agcgaccggc cctcagggat ccctgagcga   180
ttctctggct ccaactctgg gaacacggcc accctgacca tcagcagggt cgaagccggg   240
gatgaggccg actattactg tcaggtgtgg gatagtagta gtgatcatgt ggtattcggc   300
ggagggacca agctgaccgt cctaggtgcg gccgcaggcc agcccaaggc cgctcccagc   360
gtgaccctgt tcccccctc ctccgaggag ctgcaggcca acaaggccac cctggtgtgc   420
ctcatcagcg acttctaccc tggcgccgtg accgtggcct ggaaggccga cagcagcccc   480
gtgaaggccg gcgtggagac caccacccc agcaagcaga gcaacaacaa gtacgccgcc   540
agcagctacc tgagcctcac ccccgagcag tggaagagcc accggagcta cagctgccag   600
gtgacccacg agggcagcac cgtggagaag accgtggccc ccaccgagtg cagc         654

CR6339 Light Chain amino acid sequence
                                              (SEQ ID NO: 549)
QAGLTQPPSVSVAPGQTARITCGGNNIGSKSVHWYQQKPGQAPVLVVYDDSDRPSGIPERFS

GSNSGNTATLTISRVEAGDEADYYCQVWDSSSDHVVFGGGTKLTVLGAAAGQPKAAPSVTL

FPPSSEELQANKATLVCLISDFYPGAVTVAWKADSSPVKAGVETTTPSKQSNNKYAASSYLSL

TPEQWKSHRSYSCQVTHEGSTVEKTVAPTECS

CR6339 VL amino acid sequence
                                              (SEQ ID NO: 547)
QAGLTQPPSVSVAPGQTARITCGGNNIGSKSVHWYQQKPGQAPVLVVYDDSDRPSGIPERFS

GSNSGNTATLTISRVEAGDEADYYCQVWDSSSDHVVFGGGTKLTVLG
```

The CR6342 HA-specific IgG antibody includes a heavy chain variable region (SEQ ID NO: 550) encoded by the heavy chain nucleotide sequence shown in SEQ ID NO: 551 and the heavy chain amino acid sequence shown in SEQ ID NO: 552. The CR6342 HA-specific IgG antibody also includes a light chain variable region (SEQ ID NO: 553) encoded by the light chain nucleotide sequence shown in SEQ ID NO: 554 and the light chain amino acid sequence shown in SEQ ID NO: 555.

```
CR6342 Heavy Chain nucleotide sequence
                                              (SEQ ID NO: 551)
caggtccagc tggtgcagtc tggggctgag gtgaagaagc ctgggtcctc ggtgaaggtc    60
tcctgcaagg cttctggagg cttcttcagc agctatgcta tcagctgggt gcgccaggcc   120
cctggacaag gacttgagtg gatggggggg gtcatcccta tctttcgtac agcaaactac   180
gcacagaact tccagggcag agtcaccatt accgcggacg aattcacatc gtatatggag   240
ctgagcagcc tgagatctga cgacacggcc gtgtattact gtgcgaggtt gaattaccat   300
gattcgggga cttattataa cgcccccggg ggctggttcg acccctgggg ccagggaacc   360
ctggtcaccg tctcgagtgc tagcaccaag ggcccagcg tgttcccct ggccccagc    420 agcaagagca ccagcggcgg cacagccgcc ctgggctgcc tggtgaagga ctacttcccc   480
```

-continued

```
gagcccgtga ccgtgagctg aacagcggc gccttgacca gcggcgtgca caccttcccc    540
gccgtgctgc agagcagcgg cctgtacagc ctgagcagcg tggtgaccgt gcccagcagc    600
agcctgggca cccagaccta catctgcaac gtgaaccaca agcccagcaa caccaaggtg    660
gacaaacgcg tggagcccaa agctgcgac aagacccaca cctgcccccc ctgccctgcc    720
cccgagctgc tgggcggacc ctccgtgttc ctgttccccc caagcccaa ggacaccctc    780 atgatcagcc ggaccccga ggtgacctgc gtggtggtgg acgtgagcca cgaggacccc    840
gaggtgaagt tcaactggta cgtggacggc gtggaggtgc acaacgccaa gaccaagccc    900
cgggaggagc agtacaacag cacctaccgg gtggtgagcg tgctcaccgt gctgcaccag    960
gactggctga acggcaagga gtacaagtgc aaggtgagca caaggccct gcctgccccc   1020 atcgagaaga ccatcagcaa ggccaaggc cagccccggg agccccaggt gtacaccctg   1080 cccccagcc gggaggagat gaccaagaac caggtgtccc tcacctgtct ggtgaagggc   1140 ttctaccca gcgacatcgc cgtggagtgg gagagcaacg gccagcccga gaacaactac   1200
aagaccaccc cccctgtgct ggacagcgac ggcagcttct tcctgtacag caagctcacc   1260
gtggacaaga gccggtggca gcagggcaac gtgttcagct gcagcgtgat gcacgaggcc   1320
ctgcacaacc actacaccca gaagagcctg agcctgagcc ccggcaag              1368
```

CR6342 Heavy Chain amino acid sequence
(SEQ ID NO: 552)
QVQLVQSGAEVKKPGSSVKVSCKASGGFFSSYAISWVRQAPGQGLEWMGGVIPIFRTANYA

QNFQGRVTITADEFTSYMELSSLRSDDTAVYYCARLNYHDSGTYYNAPRGWFDPWGQGTLV

TVSSASTKGPSVFPLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDKTHTCPPCPAPELLGGPS

VFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLTVDKSRWQQGNVFS

CSVMHEALHNHYTQKSLSLSPGK

CR6342 VH amino acid sequence
(SEQ ID NO: 550)
QVQLVQSGAEVKKPGSSVKVSCKASGGFFSSYAISWVRQAPGQGLEWMGGVIPIFRTANYA

QNFQGRVTITADEFTSYMELSSLRSDDTAVYYCARLNYHDSGTYYNAPRGWFDPWGQGTLV

TVSS

CR6342 Light Chain nucleotide sequence
(SEQ ID NO: 554)
```
gacatccaga tgacccagtc tccagactcc ctggctgtgt ctctgggcga aaggccacc     60 atcaactgca gtccagcca gagtatttta aacagctcca caataagaa ctacttagct    120 tggtaccagc agaaaccagg acagcctcct aagctgctca tttactgggc atctacccgg    180
gaatccgggg tccctgaccg attcagtggc agcgggtctg gacagattt cactctcacc    240 atcagcagcc tgcaggctga agatgtggca gtttattact gtcagcaata ttatagtagt    300
ccgccgacgt tcggccaagg gaccaaggt gaaatcaaac gtgcggccgc acccagcgtg    360
ttcatcttcc ccctccga cgagcagctg aagagcggca ccgccagcgt ggtgtgcctg    420
ctgaacaact ctaccccg ggaggccaag gtgcagtgga aggtggacaa cgccctgcag    480
agcggcaaca gccaggagag cgtgaccgag caggacagca aggactccac ctacagcctg    540
agcagcaccc tcaccctgag caaggccgac tacgagaagc acaaggtgta cgcctgcgag    600
gtgacccacc agggcctgag cagccccgtg accaagagct caaccggggg cgagtgt     657
```

```
CR6342 Light Chain amino acid sequence
                                                     (SEQ ID NO: 555)
DIQMTQSPDSLAVSLGEKATINCKSSQSILNSSNNKNYLAWYQQKPGQPPKLLIYWASTRESG

VPDRFSGSGSGTDFTLTISSLQAEDVAVYYCQQYYSSPPTFGQGTKVEIKRAAAPSVFIFPPSD

EQLKSGTASVVCLLNNFYPREAKVQWKVDNALQSGNSQESVTEQDSKDSTYSLSSTLTLSKA

DYEKHKVYACEVTHQGLSSPVTKSFNRGEC

CR6342 VL amino acid sequence
                                                     (SEQ ID NO: 553)
DIQMTQSPDSLAVSLGEKATINCKSSQSILNSSNNKNYLAWYQQKPGQPPKLLIYWASTRESG

VPDRFSGSGSGTDFTLTISSLQAEDVAVYYCQQYYSSPPTFGQGTKVEIKR
```

The CR6343 HA-specific IgG antibody includes a heavy chain variable region (SEQ ID NO: 556) encoded by the heavy chain nucleotide sequence shown in SEQ ID NO: 557 and the heavy chain amino acid sequence shown in SEQ ID NO: 558. The CR6343 HA-specific IgG antibody also includes a light chain variable region (SEQ ID NO: 559) encoded by the light chain nucleotide sequence shown in SEQ ID NO: 560 and the light chain amino acid sequence shown in SEQ ID NO: 561.

```
CR6343 Heavy Chain nucleotide sequence
                                                     (SEQ ID NO: 557)
caggtccagc tggtgcagtc tggagctgag gtgaagaagc ctgggtcctc ggtgaaggtc     60
tcctgcaagg cttctggagt caccttcagt tactatgcta tgagctgggt gcgacaggcc    120
cctggacaag gcttgagtg gatgggagga atcagcccta tgtttgggac aacaacctac     180
gcacagaagt tccagggcag agtcacgatt actgcggacg actccacgag tacagcctac    240
atggaggtga ggagcctgag atctgaggac acggccgtgt attactgtgc gagatcttcg    300
aattactatg atagtgtata tgactactgg ggccagggaa ccctggtcac cgtctcgagt    360
gctagcacca agggcccag cgtgttcccc ctggccccca gcagcaagag caccagcggc     420
ggcacagccg ccctgggctg cctggtgaag gactacttcc ccgagcccgt gaccgtgagc    480
tggaacagcg gcgccttgac cagcggcgtg cacaccttcc ccgccgtgct gcagagcagc    540
ggcctgtaca gcctgagcag cgtggtgacc gtgcccagca gcagcctggg cacccagacc    600
tacatctgca acgtgaacca caagcccagc aacaccaagg tggacaaacg cgtggagccc    660
aagagctgcg acaagaccca cacctgcccc cctgccctg ccccgagct gctgggcgga     720 ccctccgtgt tcctgttccc cccaagccc aaggacaccc tcatgatcag ccggacccc      780 gaggtgacct gcgtggtggt ggacgtgagc cacgaggacc ccgaggtgaa gttcaactgg    840
tacgtggacg gcgtggaggt gcacaacgcc aagaccaagc ccgggagga gcagtacaac    900 agcacctacc gggtggtgag cgtgctcacc gtgctgcacc aggactggct gaacggcaag    960
gagtacaagt gcaaggtgag caacaaggcc ctgcctgccc ccatcgagaa gaccatcagc   1020
aaggccaagg gccagccccg ggagccccag gtgtacaccc tgcccccag ccgggaggag    1080 atgaccaaga accaggtgtc cctcacctgt ctggtgaagg gcttctaccc cagcgacatc   1140
gccgtggagt gggagagcaa cggccagccc gagaacaact acaagaccac cccccctgtg   1200
ctggacagcg acggcagctt cttcctgtac agcaagctca ccgtggacaa gagccggtgg   1260
cagcagggca acgtgttcag ctgcagcgtg atgcacgagg ccctgcacaa ccactacacc   1320
cagaagagcc tgagcctgag ccccggcaag                                    1350

CR6343 Heavy Chain amino acid sequence
                                                     (SEQ ID NO: 558)
QVQLVQSGAEVKKPGSSVKVSCKASGVTFSYYAMSWVRQAPGQGLEWMGGISPMFGTTTY

AQKFQGRVTITADDSTSTAYMEVRSLRSEDTAVYYCARSSNYYDSVYDYWGQGTLVTVSSA

STKGPSVFPLAPSSKSTSGGTAALGCLVKDYFPEPVTVSWNSGALTSGVHTFPAVLQSSGLYS
```

-continued

LSSVVTVPSSSLGTQTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRWQQGNVFSCSVMH

EALHNHYTQKSLSLSPGK

CR6343 VH amino acid sequence
(SEQ ID NO: 556)
QVQLVQSGAEVKKPGSSVKVSCKASGVTFSYYAMSWVRQAPGQGLEWMGGISPMFGTTTY

AQKFQGRVTITADDSTSTAYMEVRSLRSEDTAVYYCARSSNYYDSVYDYWGQGTLVTVSS

CR6343 Light Chain nucleotide sequence
(SEQ ID NO: 560)
```
cagtctgtcg tgacgcagcc gccctcggag tcagtggccc caggacagac ggccaggatt   60
acctgtgggg gacataacat tggaagtaat agtgtgcact ggtaccagca gaagccaggc  120
caggcccctg tgctggtcgt gtatgataat agcgaccggc cctcagggat ccctgagcga  180
ttctctggct ccaactctgg gaacacggcc accctgacca tcagcagggt cgaagccggg  240
gatgaggccg actattactg tcaggtgtgg ggtagtagta gtgaccatta tgtcttcgga  300
actgggacca aggtcaccgt cctaggtgcg gccgcaggcc agcccaaggc cgctcccagc  360
gtgaccctgt tccccccctc ctccgaggag ctgcaggcca acaaggccac cctggtgtgc  420
ctcatcagcg acttctaccc tggcgccgtg accgtggcct ggaaggccga cagcagcccc  480
gtgaaggccg gcgtggagac caccaccccc agcaagcaga gcaacaacaa gtacgccgcc  540
agcagctacc tgagcctcac ccccgagcag tggaagagcc accggagcta cagctgccag  600
gtgacccacg agggcagcac cgtggagaag accgtggccc ccaccgagtg cagc         654
```

CR6343 Light Chain amino acid sequence
(SEQ ID NO: 561)
QSVVTQPPSESVAPGQTARITCGGHNIGSNSVHWYQQKPGQAPVLVVYDNSDRPSGIPERFSG

SNSGNTATLTISRVEAGDEADYYCQVWGSSSDHYVFGTGTKVTVLGAAAGQPKAAPSVTLF

PPSSEELQANKATLVCLISDFYPGAVTVAWKADSSPVKAGVETTTPSKQSNNKYAASSYLSL

TPEQWKSHRSYSCQVTHEGSTVEKTVAPTECS

CR6343 VL amino acid sequence
(SEQ ID NO: 559)
QSVVTQPPSESVAPGQTARITCGGHNIGSNSVHWYQQKPGQAPVLVVYDNSDRPSGIPERFSG

SNSGNTATLTISRVEAGDEADYYCQVWGSSSDHYVFGTGTKVTVLG

The CR6344 HA-specific IgG antibody includes a heavy chain variable region (SEQ ID NO: 562) encoded by the heavy chain nucleotide sequence shown in SEQ ID NO: 563 and the heavy chain amino acid sequence shown in SEQ ID NO: 564. The CR6344 HA-specific IgG antibody also includes a light chain variable region (SEQ ID NO: 565) encoded by the light chain nucleotide sequence shown in SEQ ID NO: 566 and the light chain amino acid sequence shown in SEQ ID NO: 567.

CR6344 Heavy Chain nucleotide sequence
(SEQ ID NO: 563)
```
caggtgcagc tggtgcagtc tggggctgag gtgaagaagc ctgggtcctc ggtgagagtc   60
tcctgcaagg cttctggaag catcttcaga aactatgcta tgagctgggt gcgacaggcc  120
cctggacaag ggcttgagtg gatgggaggg atcatcgcta tttttgggac accaaagtac  180
gcacagaagt tccagggcag agtcacgatt accgcggacg aatcgacgag cactgtctac  240
atggaactga gcggactgag atctgaggac acggccatgt attactgtgc gaggattccc  300
cactataatt tggttcgggg gagttatttc gactactggg gccagggaac cctggtcacc  360
gtctcgagtg ctagcaccaa gggcccagc gtgttccccc tggccccag cagcaagagc  420
```

-continued

```
accagcggcg gcacagccgc cctgggctgc ctggtgaagg actacttccc cgagcccgtg    480
accgtgagct ggaacagcgg cgccttgacc agcggcgtgc acaccttccc cgccgtgctg    540
cagagcagcg gcctgtacag cctgagcagc gtggtgaccg tgcccagcag cagcctgggc    600
acccagacct acatctgcaa cgtgaaccac aagcccagca acaccaaggt ggacaaacgc    660
gtggagccca gagctgcga caagacccac acctgccccc cctgccctgc ccccgagctg    720
ctgggcggac cctccgtgtt cctgttcccc cccaagccca aggacaccct catgatcagc    780 cggaccccg aggtgacctg cgtggtggtg gacgtgagcc acgaggaccc cgaggtgaag    840
ttcaactggt acgtggacgg cgtggaggtg cacaacgcca agaccaagcc cggaggag    900 cagtacaaca gcacctaccg ggtggtgagc gtgctcaccg tgctgcacca ggactggctg    960
aacggcaagg agtacaagtg caaggtgagc aacaaggccc tgcctgcccc catcgagaag   1020
accatcagca aggccaaggg ccagccccgg gagcccagg tgtacaccct gcccccagc    1080 cgggaggaga tgaccaagaa ccaggtgtcc ctcacctgtc tggtgaaggg cttctacccc   1140
agcgacatcg ccgtggagtg ggagagcaac ggccagcccg agaacaacta caagaccacc   1200 cccctgtgc tggacagcga cggcagcttc ttcctgtaca gcaagctcac cgtggacaag   1260
agccggtggc agcagggcaa cgtgttcagc tgcagcgtga tgcacgaggc cctgcacaac   1320
cactacaccc agaagagcct gagcctgagc ccggcaag                           1359
```

CR6344 Heavy Chain amino acid sequence
                                    (SEQ ID NO: 564)
QVQLVQSGAEVKKPGSSVRVSCKASGSIFRNYAMSWVRQAPGQGLEWMGGIIAIFGTPKYA

QKFQGRVTITADESTSTVYMELSGLRSEDTAMYYCARIPHYNFGSGSYFDYWGQGTLVTVSS

ASTKGPSVFPLAPSSKSTSGGTAALGCLVKDYFPEPVTVSWNSGALTSGVHTFPAVLQSSGLY

SLSSVVTVPSSSLGTQTYICNVNHKPSNTKVDKRVEPKSCDKTHTCPPCPAPELLGGPSVFLFP

PKPKDTLMISRTPEVTCVVVDVSHEDPEVKFNWYVDGVEVHNAKTKPREEQYNSTYRVVSV

LTVLHQDWLNGKEYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRWQQGNVFSCSVM

HEALHNHYTQKSLSLSPGK

CR6344 VH amino acid sequence
                                    (SEQ ID NO: 562)
QVQLVQSGAEVKKPGSSVRVSCKASGSIFRNYAMSWVRQAPGQGLEWMGGIIAIFGTPKYA

QKFQGRVTITADESTSTVYMELSGLRSEDTAMYYCARIPHYNFGSGSYFDYWGQGTLVTVSS

CR6344 Light Chain nucleotide sequence
                                    (SEQ ID NO: 566)
```
actgtgttga cacagccgcc ctcagtgtct ggggccccag gcagagggt caccatctcc     60 tgcactggga gcagctccaa catcggggca ggttatgatg tacactggta ccagcagctt    120
ccaggaacag cccccaaact cctcatctat ggtaacagca atcggccctc aggggtccct    180
gaccgattct ctggctccaa gtctggcacg tcagccaccc tgggcatcac cggactccag    240
actggggacg aggccgatta ttactgcgga acatgggata gcagcctgag tgcttatgtc    300
ttcggaactg ggaccaaggt caccgtccta ggtcggccg caggccagcc caaggccgct    360
cccagcgtga ccctgttccc ccctcctcc gaggagctgc aggccaacaa ggccaccctg    420
gtgtgcctca tcagcgactt ctaccctggc gccgtgaccg tggcctggaa ggccgacagc    480
agccccgtga aggccggcgt ggagaccacc acccccagca gcagagcaa caacaagtac    540 gccgccagca gctacctgag cctcaccccc gagcagtgga agagccaccg gagctacagc    600
tgccaggtga cccacgaggg cagcaccgtg gagaagaccg tggcccccac cgagtgcagc    660

CR6344 Light Chain amino acid sequence

```
                                                                (SEQ ID NO: 567)
TVLTQPPSVSGAPGQRVTISCTGSSSNIGAGYDVHWYQQLPGTAPKLLIYGNSNRPSGVPDRF

SGSKSGTSATLGITGLQTGDEADYYCGTWDSSLSAYVFGTGTKVTVLGAAAGQPKAAPSVT

LFPPSSEELQANKATLVCLISDFYPGAVTVAWKADSSPVKAGVETTTPSKQSNNKYAASSYLS

LTPEQWKSHRSYSCQVTHEGSTVEKTVAPTECS

CR6344 VL amino acid sequence
                                                                (SEQ ID NO: 565)
TVLTQPPSVSGAPGQRVTISCTGSSSNIGAGYDVHWYQQLPGTAPKLLIYGNSNRPSGVPDRF

SGSKSGTSATLGITGLQTGDEADYYCGTWDSSLSAYVFGTGTKVTVLG
```

HA Antibody Epitopes

The invention relates to an isolated human HA antibody that is able to recognize and bind to an epitope in the HA2 subunit of the influenza haemagglutinin protein (HA) (also known as hemagglutinin(HA)), characterized in that the HA antibody has neutralizing activity against an influenza virus including HA of the H5 subtype. Examples of influenza strains that contain such a HA of the H5 subtype and that are important strains in view of pandemic threats are H5N1, H5N2, H5N8, and H5N9. Particularly preferred are HA antibodies that at least neutralize the H5N1 influenza strain. Preferably, an HA antibody of the invention does not depend on an epitope in the HA1 subunit of the HA protein for binding to said HA protein.

A number of the antibodies of the invention (such as CR6307 and CR6323) do not depend on conformational epitopes and recognize the HA2 epitope even in a reduced form (when used in western-blotting). This is an advantage over the antibodies from the art because when a conformational change is induced in the HA protein due to whatever mutation in another part of the protein, such conformational change will not most likely hamper the binding of the antibodies of the present invention to the HA2 epitope, whereas antibodies that do depend on conformation might very well be unable to bind when such mutations occur.

In another preferred embodiment, an HA antibody of the invention also has neutralizing activity against an influenza virus comprising HA of the H1 subtype, and preferably wherein the HA antibody also has neutralizing activity against influenza virus comprising HA of the H2, H6 and/or H9 subtype. The HA antibodies of the invention interact with an epitope present in the HA2 epitopes present in the H5, HI, H2, H6, and H9 subtypes (see, International Patent Application PCT/EP2007/059356, published as WO 2008/028946, the contents of which are incorporated by reference in their entirety), and it has been shown that the HA antibodies of the invention cross-neutralize between influenza subtypes because of this epitope-sharing.

In another preferred aspect of the invention an HA antibody of the invention binds to an epitope that is selected from the group consisting of the amino acid sequence: GVTNKVNSIIDK (SEQ ID NO: 198), GVTNKVNSIINK (SEQ ID NO: 283), GVTNKENSIIDK (SEQ ID NO: 202), GVTNKVNRIIDK (SEQ ID NO: 201), GITNKVNSVIEK (SEQ ID NO: 281), GITNKENSVIEK (SEQ ID NO: 257), GITNKVNSIIDK (SEQ ID NO: 225), and KITSKVNNIVDK (SEQ ID NO: 216). Certain HA antibodies of the invention, CR6261, CR6325, and CR6329 interact with the GVTNKVNSIIDK (SEQ ID NO: 198) epitope present in H5N1, and are not hampered by a mutation in the TGLRN (SEQ ID NO: 200) epitope in HA1 that do influence the binding of C179. Moreover, some HA antibodies, such as CR6307 and CR6323 are not even hampered by a escape mutant, as disclosed in Okuno et al. (1993) with a valine→glutamic acid mutation at position 6 (exemplified by GVTNKENSIIDK (SEQ ID NO: 202)). This epitope is part of an extended alpha helix in the HA2 region. The residues in this putative epitope that are predicted to be most solvent exposed are underlined in bold: GV-TNKENSIIDK (SEQ ID NO: 202). These amino acids would be most accessible to an HA antibody and thus may form the most important region of the epitope. Consistent with this notion the highlighted (bolded) amino acids are absolutely conserved in identity and position in all the sequences presented. This knowledge could be used to predict binding epitopes in influenza subtypes that do not carry the same sequence as above (i.e. H3, H7 and B strains).

HA Antibodies II

The invention provides neutralizing human monoclonal antibodies that bind influenza A virus and inhibit the influenza A virus from infecting a cell. Although neutralizing human monoclonal antibodies of the invention bind epitopes within proteins that are exposed on the surface of an influenza virus, the invention focuses on the relatively invariant Influenza hemagglutinin (HA) protein. A neutralizing MAb raised against an Influenza HA protein, which is maintained in its native conformation, provides a superior therapy for all Influenza A strains because it is not dependent upon small changes to the amino acid sequence.

The Influenza hemagglutinin (HA) protein is responsible for allowing the virus to recognize target cells through binding the monosaccharide sialic acid-containing receptors on the surface of the target cell prior to infection. Moreover, the Influenza HA protein is responsible for allowing entry of the viral genome into the target cell by fusing the host endosomal membrane with the viral membrane.

The Influenza hemagglutinin (HA) protein is a homotrimeric integral membrane glycoprotein found on the surface of the Influenza virus. Using the host cell's protein synthesis machinery, the Influenza HA protein is first synthesized as a single-chain precursor polypeptide (HA0) in the endoplasmic reticulum, where it is also assembled as a homotrimer. The resulting HA homotrimer is subsequently exported to the cell surface via the Golgi network. HA homotrimers located on a cell surface are cleaved by a host-produced protease into two smaller peptide subunits: HA1 and HA2. The HA2 subunit forms a long helical chain anchored to the viral membrane whereas the HA1 subunit tops the HA2 subunit to form a large globule. The cleavage step, which converts the HA0 precursor into the mature HA protein containing HA1 and HA2 subunits, is essential for the viral pathogenicity of Influenza. Structurally, the mature HA protein contains a central α-helix coil resulting in an overall cylindrical shape with three spherical heads. The HA protein, and specifically, the HA1 subunit of the mature HA protein, binds receptors containing glycans with terminal sialic acids on host cells. The way in which sialic acid is connected to galactose, for example, α2-3 linkages as in avian serotypes versus α2-6 linkages as in human serotypes, not only determine species specificity of an Influenza virus, but also prevents cross-species infection. However, within certain serotypes of HA, such as H1 and H3, only two amino acid mutations in the framework sequence are required to convert species specificity from avian to human.

To mediate infection, the Influenza HA protein first binds sialic acid-containing receptors present on the surface of the target cell. Consequently, the target cell membrane endocytoses or engulfs the Influenza virus. Once inside the endosome, and upon the host cell's acidification of that compartment, the Influenza HA protein partially unfolds revealing a very hydrophobic fusion peptide that inserts itself into the endosomal membrane. As the rest of the Influenza HA protein refolds, the fusion protein retracts and fuses the endosomal membrane with the viral membrane. Upon fusion of the cellular and viral membranes, the contents of the virus, including the viral genome, are released in the cytoplasm of the target cell.

At least 16 different Influenza A hemagglutinin serotypes or antigens have been identified: H1-H16. Only HA serotypes H1-H3 normally mediate human Influenza infection. However, Influenza strains thought to infect only certain avian or mammalian species can mutate to infect humans. As described above, only a few amino acids need to change along the length of the entire protein to enable Influenza to cross a species barrier. For instance, a single amino acid change in the sequence of the H5 subtype allowed an avian-specific Influenza strain to become infectious in humans (H5N1). A pandemic arose when an Influenza strain common to swine species, became lethal to humans (H1N1). In contrast to Influenza A, Influenza B and C viruses each contain only one form of HA protein.

Specifically, the invention provides an isolated fully human monoclonal antibody, wherein said monoclonal antibody has the following characteristics: a) binds to an influenza A virus; b) binds to a cell contacted with influenza A; c) binds to an epitope of an influenza A viral protein; and, optionally, d) neutralizes influenza A virus infection. An antibody that does not neutralize influenza A virus infection may be used, for instance, for a conjugate therapy. In certain aspects, this antibody binds to a eukaryotic cell. Moreover, the cell is optionally a human cell.

In another aspect, this antibody is isolated from a B-cell from a human donor. Isolation of a fully human monoclonal antibody of the invention from a B-cell is performed using recombinant methods. Alternatively, or in addition, the isolated fully human monoclonal antibody of the invention is isolated from the supernatant of a plasma cell cultured either in vitro or ex vivo. Plasma cells also known as a differentiated B-cells, plasma B-cells, plasmacytes, or effector B-cells. The fully human monoclonal antibody isolated from either a B-cell or a plasma cell demonstrates neutralizing activity.

Antibodies of the invention bind to an epitope of influenza A viral hemagglutinin (HA) protein. Exemplary HA epitopes to which the antibodies of the invention bind include a hemagglutinin precursor peptide (HA0), a HA1 subunit, a HA2 subunit, a mature protein containing HA1 and HA2, and a recombinant HA polypeptide. Alternatively, antibodies of the invention bind to an epitope within a hemagglutinin precursor peptide (HA0), a HA1 subunit, a HA2 subunit, a mature protein containing HA1 and HA2, or a recombinant HA polypeptide. Recombinant HA polypeptides are encoded, for example, by the sequence of SEQ ID NO: 727, 728, 729, 730, 731, 732, 733, 734, 735, 736, 737, 738, 739, 740, 741, 742, 743, or 744.

Antibodies of the invention bind to an epitope that is linear or non-linear. In certain aspects of the invention, a non-linear epitope is a discontinuous epitope.

An antibody of the invention is TCN-522 (3212_I12), TCN-521 (3280_D18), TCN-523 (5248_A17), TCN-563 (5237_B21), TCN-526 (5084_C17), TCN-527 (5086_C06), TCN-528 (5087_P17), TCN-529 (5297_H01), TCN-530 (5248_H10a), TCN-531 (5091_H13), TCN-532 (5262_H18), TCN-533 (5256_A17), TCN-534 (5249_B02), TCN-535 (5246_P19), TCN-536 (5095_N01), TCN-537 (3194_D21), TCN-538 (3206_O17), TCN-539 (5056_A08), TCN-540 (5060_F05), TCN-541 (5062_M11), TCN-542 (5079_A16), TCN-543 (5081_G23), TCN-544 (5082_A19), TCN-545 (5082_I15), TCN-546 (5089_L08), TCN-547 (5092_F11), TCN-548 (5092_P01), TCN-549 (5092_P04), TCN-550 (5096_F06), TCN-551 (5243_D01), TCN-552 (5249_I23), TCN-553 (5261_C18), TCN-554 (5277_M05), TCN-555 (5246_L16), TCN-556 (5089_K12), TCN-557 (5081_A04), TCN-558 (5248_H10b), TCN-559 (5097_G08), TCN-560 (5084_P10), or TCN-504 (3251_K17).

The invention further encompasses an antibody that binds the same epitope as TCN-522 (3212_I12), TCN-521 (3280_D18), TCN-523 (5248_A17), TCN-563 (5237_B21), TCN-526 (5084_C17), TCN-527 (5086_C06), TCN-528 (5087_P17), TCN-529 (5297_H01), TCN-530 (5248_H10a), TCN-531 (5091_H13), TCN-532 (5262_H18), TCN-533 (5256_A17), TCN-534 (5249_B02), TCN-535 (5246_P19), TCN-536 (5095_N01), TCN-537 (3194_D21), TCN-538 (3206_O17), TCN-539 (5056_A08), TCN-540 (5060_F05), TCN-541 (5062_M11), TCN-542 (5079_A16), TCN-543 (5081_G23), TCN-544 (5082_A19), TCN-545 (5082_I15), TCN-546 (5089_L08), TCN-547 (5092_F11), TCN-548 (5092_P01), TCN-549 (5092_P04), TCN-550 (5096_F06), TCN-551 (5243_D01), TCN-552 (5249_I23), TCN-553 (5261_C18), TCN-554 (5277_M05), TCN-555 (5246_L16), TCN-556 (5089_K12), TCN-557 (5081_A04), TCN-558 (5248_H10b), TCN-559 (5097_G08), TCN-560 (5084_P10), or TCN-504 (3251_K17).

The invention provides an isolated fully human monoclonal anti-HA antibody or fragment thereof, wherein said antibody includes a variable heavy chain ($V_H$) region comprising CDR1 and CDR2, wherein the $V_H$ region is encoded by a human IGHV1 (or specifically, IGHV1-18, IGHV1-2, IGHV1-69, IGHV1-8), IGHV2 (or specifically, IGHV2-5), IGHV3 (or specifically, IGHV3-30, IGHV3-33, IGHV3-49, IGHV3-53, 66, IGHV3-7), IGHV4 (or specifically, IGHV4-31, IGHV4-34, IGHV4-39, IGHV4-59, IGHV4-61), or IGHV5 (or specifically, IGHV5-51) $V_H$ germline sequence or an allele thereof, or a nucleic acid sequence that is homologous to the IGHV1, IGHV2, IGHV3, IGHV4, or IGHV5 $V_H$ germline gene sequence or an allele thereof. In one aspect, the nucleic acid sequence that is homologous to the IGHV1, IGHV2, IGHV3, IGHV4, or IGHV5 $V_H$ germline sequence is at least 75% homologous to the IGHV1, IGHV2, IGHV3, IGHV4, or IGHV5 $V_H$ germline sequence or an allele thereof. Exemplary alleles include, but are not limited to, IGHV1-18*01, IGHV1-2*02, IGHV1-2*04, IGHV1-69*01, IGHV1-69*05, IGHV1-69*06, IGHV1-69*12, IGHV1-8*01, IGHV2-5*10, IGHV3-30-3*01, IGHV3-30*03, IGHV3-30*18, IGHV3-33*05, IGHV3-49*04, IGHV3-53*01, IGHV3-66*03, IGHV3-7*01, IGHV4-31*03, IGHV4-31*06, IGHV4-34*01, IGHV4-34*02, IGHV4-34*03, IGHV4-34*12, IGHV4-39*01, IGHV4-59*01, IGHV4-59*03, IGHV4-61*01, IGHV4-61*08, and IGHV5-51*01.

An antibody of the invention, or specifically, any antibody described herein, may be operably-linked to a therapeutic agent or a detectable label.

The invention further provides a pharmaceutical composition including an antibody described herein and a pharmaceutical carrier. This composition optionally includes an anti-viral drug, a viral entry inhibitor or a viral attachment inhibitor. Exemplary anti-viral drugs include, but are not limited to, a neuraminidase inhibitor, a HA inhibitor, a sialic acid inhibitor and an M2 ion channel inhibitor. In one embodiment of the composition, the M2 ion channel inhibitor is amantadine or rimantadine. Alternatively, or in addition, the neuraminidase inhibitor zanamivir or oseltamivir phosphate. The composition may also include a second anti-Influenza A antibody. The second anti-Influenza A antibody is optionally an antibody described herein.

The invention provides a method for stimulating an immune response in a subject, including administering to the subject the pharmaceutical composition described herein.

Moreover, the invention provides a method for the treatment of an Influenza virus infection in a subject, including administering to the subject the pharmaceutical composition described herein. This method further includes administering an anti-viral drug, a viral entry inhibitor or a viral attachment inhibitor.

The invention also provides a method for the prevention of an Influenza virus infection in a subject, including administering to the subject the pharmaceutical composition described herein prior to exposure of the subject to Influenza virus or infection. This method further includes administering an anti-viral drug, a viral entry inhibitor or a viral attachment inhibitor. This method may be a method of vaccination.

The subject of these methods may have an Influenza infection or is predisposed to developing an Influenza virus infection. Subjects predisposed to developing an Influenza infection, or who may be at elevated risk for contracting an infection, are those subjects with compromised immune systems because of autoimmune disease, those persons receiving immunosuppressive therapy (for example, following organ transplant), those persons afflicted with human immunodeficiency syndrome (HIV) or acquired immune deficiency syndrome (AIDS), certain forms of anemia that deplete or destroy white blood cells, those persons receiving radiation or chemotherapy, or those persons afflicted with an inflammatory disorder. Additionally, subject of extreme young or old age are at increased risk. Any person who comes into physical contact or close physical proximity with an infected individual has an increased risk of developing an Influenza virus infection. Moreover, a subject is at risk of contracting an influenza infection due to proximity to an outbreak of the disease, e.g. subject resides in a densely-populated city or in close proximity to subjects having confirmed or suspected infections of Influenza virus, or choice of employment, e.g. hospital worker, pharmaceutical researcher, traveler to infected area, or frequent flier.

According to the methods described herein, exemplary anti-viral drugs include, but are not limited to, a neuraminidase inhibitor, a HA inhibitor, a sialic acid inhibitor and an M2 ion channel. In one aspect of these methods, the M2 ion channel inhibitor is amantadine or rimantadine. Alternatively, or in addition, the neuraminidase inhibitor is zanamivir or oseltamivir phosphate.

These methods optionally include administering a second anti-Influenza A antibody. For example, the antibody is administered prior to or after exposure to Influenza virus. In certain aspects of these methods, the antibody is administered at a dose sufficient to promote viral clearance or to eliminate Influenza A infected cells. The second antibody is optionally an antibody described herein The invention further provides a method for determining the presence of a Influenza virus infection in a subject, including the steps of: (a) contacting a biological sample obtained from the subject with an antibody described herein or the pharmaceutical composition described herein; (b) detecting an amount of the antibody that binds to the biological sample; and (c) comparing the amount of antibody that binds to the biological sample to a control value, and therefrom determining the presence of the Influenza virus in the subject.

The invention provides a vaccine composition including an antibody described herein. This composition optionally contains a pharmaceutical carrier.

Alternatively, the invention provides a vaccine composition including an epitope of an antibody described herein. This composition optionally contains a pharmaceutical carrier.

Vaccines of the invention are multivalent vaccines. The term "multivalent vaccine" is meant to describe a single vaccine that elicits an immune response either to more than one infectious agent, e.g. recombinant homotrimeric HA0 proteins or fragments thereof derived from multiple strains of Influenza A (see, Table 9), or to several different epitopes of a molecule, e.g. a linear and a discontinuous epitope of the same recombinant homotrimeric HA0 protein or fragment thereof derived from a single strain of Influenza A. Alternatively, or in addition, the term multivalent vaccine is meant to describe the administration of a combination of human antibodies raised against more than one infectious agent, e.g. a combination of HuMHA antibodies raised against recombinant homotrimeric HA0 proteins or fragments thereof derived from multiple strains of Influenza A (see, Table 9).

The invention provides a diagnostic kit including an antibody described herein.

The invention provides a prophylactic kit including an antibody described herein or an epitope of an antibody described herein. Alternatively, or in addition, the invention provides a prophylactic kit including a vaccine composition described herein.

In a preferred embodiment, the present invention provides fully human monoclonal antibodies specifically directed against the Influenza hemagglutinin glycoprotein, which neutralize influenza infection. Optionally, the antibody is isolated from a B-cell from a mammalian donor, and preferably, a human donor. In certain embodiments of the invention, the antibody is identified for its ability to bind an intact or whole Influenza virus. Alternatively, or in addition, the antibody is identified isolated for its ability to bind to an epitope of a recombinant homotrimeric Influenza HA0 protein or HA protein(s) isolated from multiple Influenza strains, or made as recombinant proteins such as those influenza A virus strains provided in Table 9. Alternatively, or in addition, the antibody is identified for its ability to inhibit or neutralize virus infection of susceptible eukaryotic cells. Exemplary neutralizing antibodies of this profile include, but are not limited to, those antibodies listed in Table 10. Alternatively, the monoclonal antibody is an antibody that binds to the same epitope as the antibodies provided in Table 10. In certain embodiments, neutralizing human monoclonal antibodies of the invention are anti-HA antibodies. A monoclonal anti-HA antibody of the invention has one or more of the following characteristics: a) binds to an epitope in an HA1 subunit of an Influenza hemagglutinin (HA) protein; b) binds to an epitope in the HA2 subunit of Influenza hemagglutinin (HA) protein; c) binds to an epitope in the extracellular domain of an Influenza hemagglutinin (HA) protein, consisting of an HA1 subunit and an HA2 subunit; d) binds to an epitope of a recombinant homotrimeric Influenza HA0 protein; e) binds to an epitope of an Influenza HA protein expressed on an infected cell; f) binds to an epitope of an Influenza HA protein expressed on a modified cell; g) binds to an Influenza virus; or h) inhibits virus infection of susceptible eukaryotic cells.

Modified cells of the invention are transfected or transformed with a polynucleotide that encodes an Influenza HA protein, or any fragment thereof. The term "Influenza HA protein fragment" is meant to describe any portion of the protein that is smaller or less than the entire protein. Polynucleotides and polypeptides of the invention do not always encode a functional Influenza HA protein.

Infected cells of the invention are mammalian, and preferably human in origin. Specifically, mammalian cells are infected with Influenza A virus in vivo, in vitro, in situ, ex vivo, in culture, and any combination thereof. Cells are infected with active or inactive virions. Exemplary inactive virions display the HA protein on their surfaces, however, Alternatively, the monoclonal anti-HA antibodies described herein bind membrane-bound and soluble recombinant homotrimeric Influenza HA proteins. In certain embodiments of the invention, the monoclonal anti-HA antibodies described herein bind and neutralize Influenza virus subtypes H1, H2, and H3. In other embodiments of the invention, the monoclonal anti-HA antibodies bind Influenza virus subtypes H1, H2, and H3, and neutralize one of these subtypes, such as H1, H2, or H3. In a specific embodiment, the monoclonal anti-HA antibodies bind Influenza subtypes H1N1, H2N2, and H3N2, and neutralize H1N1.

In one aspect, the HA precursor polypeptide (HA0) of the soluble and recombinant homotrimeric Influenza HA protein contains a trimerization domain (foldon) encoded in the phage T4 fibritin. An exemplary trimerization domain isolated from the phage T4 fibritin has the following sequence wherein a thrombin cleavage site is italicized and bolded, a T4 trimerization domain or sequence is underlined, a V5 tag is boxed, and a hexa-histidine (His) tag is bolded:

SGR*LVPRGS*PGSGYIPEAPRDGQAYVRKDGEWVLLSTFL GKPIPNPLLGLDSTG HHHHHH   (SEQ ID NO: 726).

they are replication-defective, and therefore, unable to propagate within the cell or subject.

Epitopes of the human monoclonal antibodies of the invention include a transmembrane or integral membrane Influenza A protein. Specifically, epitopes of the human monoclonal antibodies of the invention comprise Influenza hemagglutinin (HA) protein.

Epitopes of the human monoclonal antibodies of the invention include one or more subunits of an influenza hemagglutinin (HA) protein. HA proteins of the invention include hemagglutinin precursor proteins (HA0), the HA1 subunit, the HA2 subunit, the mature protein containing the HA1 and HA2 subunits, and a recombinant HA protein. Recombinant HA proteins contain SEQ ID NO: 726. Exemplary recombinant proteins include but, are not limited to, those proteins described by SEQ ID NO: 727-744.

Epitopes of the human monoclonal antibodies of the invention are linear or non-linear. For instance, a non-linear epitope is discontinuous. Discontinuous epitopes are available for antibody binding only when the Influenza HA protein is maintained in its native homotrimeric conformation. When an antibody binds to a discontinuous epitope, the antibody binds to a three-dimensional surface of the target protein, i.e. the As used herein, the term "neutralizing antibody" is meant to describe an antibody that inhibits or prevents influenza A infection, inhibits or prevents Influenza A viral entry into a cell, inhibits or prevents influenza replication, inhibits or prevents influenza egress from a host cell, or reduces the Influenza A titer in a cell, biological sample, or subject. In a preferred embodiment, neutralizing antibodies of the invention prevent viral entry into the cytoplasmic compartment of host cells.

The present invention provides fully human monoclonal antibodies that bind influenza virus and neutralize infection. In certain embodiments, the present invention provides fully human monoclonal neutralizing antibodies specific against the Influenza hemagglutinin protein. The antibodies are respectively referred to herein is human monoclonal anti-HA (huMHA) antibodies.

The Influenza hemagglutinin (HA) protein is a homotrimeric integral membrane glycoprotein found on the surface of the Influenza virus. To mimic the native conformation of this homotrimeric protein, the methods of the invention provide an isolated HA protein precursor that is operably-linked to a trimerization or foldon domain from the phage T4 fibritin protein (SGR*LVPRGS*PGSGYIPEAPRDGQAYVRKDGEWVLLSTFL GKPIPNPLLGLDSTG HHHHHH   (SEQ ID NO: 726)).

Influenza HA protein, upon which juxtaposed amino acids are alternatively exposed or masked.

Recombinant homotrimeric HA0 proteins of the invention are encoded by, for instance, sequences described by any one of SEQ ID NO: 727-744. In certain embodiments of the invention, the human monoclonal antibodies, or monoclonal anti-HA antibodies, described herein bind membrane-bound or soluble recombinant homotrimeric Influenza HA proteins.

The resultant recombinant homotrimeric foldon HA protein not only retains the native Influenza hemagglutinin homotrimeric conformation, but also becomes soluble, i.e. the protein is no longer bound to a viral or cellular membrane. Specifically, these recombinant HA homotrimeric proteins lack an integral membrane or transmembrane domain. In certain embodiments, these recombinant HA homotrimeric proteins include HA1 and HA2 subunits as well as a trimerization domain, the resultant recombinant HA homotrimeric protein containing between 1-50, 50-100, 100-150, 150-200, 200-250, 250-300, 300-350, 350-400, 400-450, 450-500, 500-550, 550-600 amino acids (aa) or any length of amino acids in between. Preferably, these recombinant HA homotrimeric proteins contain between 565-575 amino acids (aa). Recombinant HA homotrimeric proteins further include a signal cleavage site at the N-terminus containing between 15-25 aa. Alternatively, or in addition, recombinant HA homotrimeric proteins further include a transmembrane domain positioned between amino acids 525-535 of HA depending on the influenza A virus subtype. In a preferred embodiment, the HA protein is derived from one or more strains of an Influenza A virus. Recombinant HA homotrimeric proteins of the invention retain the native signal sequence to enable secretion. Moreover, recombinant HA homotrimeric proteins of the invention contain a same signal sequence, which is not derived from HA. Futhermore, signal sequences used with recombinant HA homotrimeric proteins of the invention include those signal sequences known in the art that allow efficient secretion of proteins, such as the signal sequence of the immunoglobulin light kappa chain. Alternatively, recombinant HA homotrimeric proteins, or the HA0 precursors thereof, may have the native signal sequences in the expression constructs used by Immune Technology Corp. (http://www.immune-tech.com/). Signal sequences are retained or manipultated to allow efficient secretion from, for instance, art-recognized cell lines maintained in vitro, e.g. 293 HEK cells.

Recombinant HA homotrimeric proteins may retain a native HA1/HA2 protease cleavage site, which is critical for viral pathogenicity. In one aspect of the invention, recombinant HA homotrimeric proteins contain a substituted HA1/HA2 protease cleavage site. For example, the recombinant HA protein encoded by SEQ ID NO: 737 does not have a native cleavage site, but rather a cleavage site substituted from another HA protein. Furthermore, these proteins optionally retain sialic acid-containing receptor binding sites within the HA1 subunit.

According to the methods of the invention, human antibodies obtained from blood, serum, plasma, or cerebral spinal fluid, are contacted to recombinant and soluble HA homotrimers of the invention in vitro, wherein the recombinant and soluble HA homotrimers act as targets for human antibody binding to confirm specificity of the isolated human antibody for an Influenza HA homotrimer in its native conformation. In general, the methods include obtaining serum or plasma samples from subjects or patients that have been infected with or vaccinated against an infectious agent. These serum or plasma samples are then screened to identify those that contain antibodies specific for a particular polypeptide associated with the infectious agent, such as, e.g. a polypeptide specifically expressed on the surface of cells infected with the infectious agent, but not uninfected cells. In particular embodiments, the serum or plasma samples are screened by contacting the samples with a cell that has been transfected with an expression vector that expresses the polypeptide expressed on the surface of infected cells. In particular embodiments the serum or plasma samples are screened by contacting the samples with a recombinant protein which represents a particular protein of the infectious agent such as, e.g. hemagglutinin of the influenza A virus. In particular embodiments the serum or plasma samples are screened by contacting the samples with a purified form of the infectious agent such as, e.g. intact whole virions of the influenza A virus. In particular embodiments, the serum or plasma samples are screened by contacting the samples with a live form of the infectious agent such as, e.g. intact whole virions of the influenza A virus to determine the presence of serum antibodies that inhibit or neutralize infection of susceptible cells. Exemplary susceptible cells are eukaryotic or mammalian cells, such as MDCK cells.

Once a subject or patient is identified as having serum or plasma containing an antibody specific for the infectious agent polypeptide or virus of interest, mononuclear and/or B cells obtained from the same subject or patient are used to identify a cell or clone thereof that produces the antibody, using any of the methods described herein or available in the art. Once a B cell that produces the antibody is identified, cDNAs encoding the variable regions or fragments thereof of the antibody may be cloned using standard RT-PCR vectors and primers specific for conserved antibody sequences, and subcloned into expression vectors used for the recombinant production of monoclonal antibodies specific for the infectious agent polypeptide of interest.

More specifically, B cells are collected from a particular donor, i.e. a subject or patient is identified as having serum or plasma containing an antibody specific for HA, cultured, and antibody is secreted from these B cells into the culture medium. The culture medium is separated from these B cells, the B cells are lysed, and then frozen for storage. The culture medium is then screened for antibody binding to various HA targets and/or inhibition/neutralization of infection in vitro. When a culture well is identified as having an antibody of the desired specificity, reverse-transcriptase polymerase chain reaction (RT-PCR) is applied to the B-cell lysate to amplify the antibody variable regions and subsequently clone, express, and test for binding and function of the recombinant antibody, Human antibodies, such as the MAbs listed in Table 10, which bind the recombinant and soluble HA homotrimer and/or bind whole virions, and optionally inhibit or neutralize infection of live virus are recombinantly reproduced and formulated into a pharmaceutical composition for administration to a subject at risk of contacting an Influenza virus. Furthermore, recombinant and soluble HA homotrimers are derived from multiple strains of Influenza viruses, including multiple strains of influenza A virus. Exemplary human antibodies specifically bind Influenza A, and may be selected for an inability to bind influenza B and C virus strains.

The invention further provides a novel process whereby full-length HA is expressed in mammalian cell lines, which allows for the identification of human antibodies that bind this cell-expressed HA. The huMHA antibodies have been shown to bind conformational determinants on the HA-transfected cells, as well as native HA, which can be isolated, or contacted to huMHA antibodies when presented either on Influenza infected cells or on Influenza A virus. Alternatively, or in addition, huMHA antibodies bind native HA, recombinant homotrimeric HA, purified virus, infected cells, linear peptide, synthetic HA peptide, HA transfected mammalian cells, and HA expressed on the surface of genetically altered bacteriophage virus, which are used for gene fragment display assays. Thus, this invention has allowed for the identification and production of human monoclonal antibodies that exhibit novel specificity for a very broad range of Influenza A virus strains. These antibodies may be used prophylactically to prevent Influenza A infection, diagnostically to identify Influenza A infection and therapeutically to treat Influenza A infection. Moreover, the epitopes to which huMHA antibodies of the invention bind are used as vaccines to prevent influenza A infection.

The huMHA antibodies of the invention has one or more of the following characteristics: a) binds to an epitope in an HA1 subunit of an Influenza hemagglutinin (HA) protein; b) binds to an epitope in the HA2 subunit of Influenza hemagglutinin (HA) protein; c) binds to an epitope in the extracellular domain of an Influenza hemagglutinin (HA) protein, consisting of an HA1 subunit and an HA2 subunit; d) binds to an epitope of a recombinant homotrimeric Influenza HA0 protein; e) binds to an epitope of an Influenza HA protein expressed on an infected cell; binds to an epitope of an Influenza HA protein expressed on a modified cell; g) binds to an Influenza virus; or h) inhibits virus infection of susceptible eukaryotic cells. The huMHA antibodies of the invention eliminate Influenza infected cells through immune effector mechanisms such as ADCC and/or CDC and promote direct viral clearance by binding to Influenza virions.

Exemplary Influenza A strains used for screening human plasma samples, B Cell Culture supernatants (BCC SN), and monoclonal transfection supernatants (MN are shown in Table 8 below). Live strains were used for the neutralization assays described herein. Inactivated strains were used for the virus binding assays described herein. Recombinant homotrimeric HA protein was used in the trimeric HA binding assay.

TABLE 8

| Virus | Subtype | Neutralization | Virus binding | Trimeric HA binding |
|---|---|---|---|---|
| A/California/4/09 | H1 | | | + |
| A/Solomon Islands/3/06 | H1 | + | + | + |
| A/South Carolina/1/18 | H1 | | | + |
| A/Japan/305/57 | H2 | | + | + |
| A/Wisconsin/67/05 | H3 | + | + | + |
| A/s wine/Ontario/01911-2/99 | H4 | | | + |
| A/Vietnam/1203/04 | H5 | | | + |
| A/Indonesia/5/05 | H5 | | | + |
| A/Egypt/3300-NAMRU3/08 | H5 | | | + |
| A/common magpie/Hong Kong/5052/07 | H5 | | | + |
| A/Anhui/1/05 | H5 | | | + |
| A/chicken/Vietnam/NCVD-016/08 | H5 | | | + |
| A/Hong Kong/156/97 | H5 | | | + |
| A/northern shoveler/California/HKWF115/07 | H6 | | | + |
| A/Netherlands/219/03 | H7 | | | + |
| A/duck/Yangzhou/02/05 | H8 | | | + |
| A/Hong Kong/2108/03 | H9 | | | + |
| A/Hong Kong/1073/99 | H9 | | | + |

Exemplary HA sequences include those sequences listed on Table 9 below.

TABLE 9

| Type | GenBank Accession No. | Subtype | HA Sequence from Strain | SEQ ID NO: |
|---|---|---|---|---|
| A | ACP41105 | H1 | A/California/04/2009(H1N1) | SEQ ID NO: 727 |
| A | ABU99109 | H1 | A/Solomon Islands/3/2006 (H1N1) | SEQ ID NO: 728 |
| A | AFI17241 | H1 | A/South Carolina/1/18 (H1N1) | SEQ ID NO: 729 |
| A | AAA43185 | H2 | A/Japan/305/1957 (H2N2) | SEQ ID NO: 730 |
| A | ACF54576 | H3 | A/Wisconsin/67/2005 (H3N2) | SEQ ID NO: 731 |

TABLE 9-continued

| Type | GenBank Accession No. | Subtype | HA Sequence from Strain | SEQ ID NO: |
|---|---|---|---|---|
| A | AAG17427 | H4 | A/Swine/Ontario/01911-2/99 (H4N6) | SEQ ID NO: 732 |
| A | AF028709 | H5 | A/Hong Kong/156/97 (H5N1) | SEQ ID NO: 733 |
| A | AAT73274 | H5 | A/VietNam/1203/2004 (H5N1) | SEQ ID NO: 734 |
| A | ABW06108 | H5 | A/Indonesia/5/2005 (H5N1) | SEQ ID NO: 735 |
| A | ACI06185 | H5 | A/Egypt/3300-NAMRU3/2008 (H5N1) | SEQ ID NO: 736 |
| A | ACJ26242 | H5 | A/common magpie/Hong Kong/5052/2007 (H5N1) | SEQ ID NO: 737 |
| A | ABD28180 | H5 | A/Anhui/1/2005(H5N1) | SEQ ID NO: 738 |
| A | ACO07033 | H5 | A/chicken/Vietnam/NCVD-016/2008(H5N1) | SEQ ID NO: 739 |
| A | ACE81692 | H6 | A/northern shoveler/California/HKWF115/2007 (H6N1) | SEQ ID NO: 740 |
| A | AAR02640 | H7 | A/Netherlands/219/03 (H7N7) | SEQ ID NO: 741 |
| A | ABK32094 | H8 | A/duck/Yangzhou/02/2005 (H8N4) | SEQ ID NO: 742 |
| A | ABB58945 | H15 | A/HK/2108/2003 (H9N2) | SEQ ID NO: 743 |
| A | NC_004908 | H9 | A/Hong Kong/1073/99 (H9N2) | SEQ ID NO: 744 |

In one embodiment, the huMHA antibodies of the invention bind to an HA that wholly or partially includes the amino acid residues from position 1 to position 525 of Influenza hemagglutinin when numbered in accordance with SEQ ID NO: 727-744. Alternatively, the monoclonal antibody is an antibody that binds to the same epitope as the mAbs listed in Table 10.

TABLE 10

| BCC well ID | Theraclone ID |
|---|---|
| 3251_K17 | TCN-504 |
| 3280_D18 | TCN-521 |
| 3212_I12 | TCN-522 |
| 5248_A17 | TCN-523 |
| 5237_B21 | TCN-524 |
| 5084_C17 | TCN-526 |
| 5086_C06 | TCN-527 |
| 5087_P17 | TCN-528 |
| 5297_H01 | TCN-529 |
| 5248_H10a | TCN-530 |
| 5091_H13 | TCN-531 |
| 5262_H18 | TCN-532 |
| 5256_A17 | TCN-533 |
| 5249_B02 | TCN-534 |
| 5246_P19 | TCN-535 |
| 5095_N01 | TCN-536 |
| 3194_D21 | TCN-537 |
| 3206_O17 | TCN-538 |
| 5056_A08 | TCN-539 |
| 5060_F05 | TCN-540 |
| 5062_M11 | TCN-541 |
| 5079_A16 | TCN-542 |
| 5081_G23 | TCN-543 |
| 5082_A19 | TCN-544 |
| 5082_I15 | TCN-545 |
| 5089_L08 | TCN-546 |
| 5092_F11 | TCN-547 |
| 5092_P01 | TCN-548 |
| 5092_P04 | TCN-549 |
| 5096_F06 | TCN-550 |
| 5243_D01 | TCN-551 |
| 5249_I23 | TCN-552 |
| 5261_C18 | TCN-553 |

TABLE 10-continued

| BCC well ID | Theraclone ID |
|---|---|
| 5277_M05 | TCN-554 |
| 5246_L16 | TCN-555 |
| 5089_K12 | TCN-556 |
| 5081_A04 | TCN-557 |
| 5248_H10b | TCN-558 |
| 5097_G08 | TCN-559 |
| 5084_P10 | TCN-560 |

The antibodies of the invention are able to neutralize Influenza A. Monoclonal antibodies can be produced by known procedures, e.g., as described by R. Kennet et al. in "Monoclonal Antibodies and Functional Cell Lines; Progress and Applications". Plenum Press (New York), 1984. Further materials and methods applied are based on known procedures, e.g., such as described in J. Virol. 67:6642-6647, 1993.

These antibodies can be used as prophylactic or therapeutic agents upon appropriate formulation, or as a diagnostic tool.

A "neutralizing antibody" is one that can neutralize the ability of that pathogen to initiate and/or perpetuate an infection in a host and/or in target cells in vitro. The invention provides a neutralizing monoclonal human antibody, wherein the antibody recognizes an antigen from an Influenza virus, which is preferably derived from the HA protein. Preferably an antibody according to the invention is a novel monoclonal antibody referred to herein as TCN-522 (corresponding to BCC plate and well location 3212_I12), TCN-521 (3280_D18), TCN-523 (5248_A17), TCN-563 (5237_B21), TCN-526 (5084_C17), TCN-527 (5086_C06), TCN-528 (5087_P17), TCN-529 (5297_H01), TCN-530 (5248_H10a), TCN-531 (5091_H13), TCN-532 (5262_H18), TCN-533 (5256_A17), TCN-534 (5249_B02), TCN-535 (5246_P19), TCN-536 (5095_N01), TCN-537 (3194_D21), TCN-538 (3206_O17), TCN-539 (5056_A08), TCN-540 (5060_F05), TCN-541 (5062_M11), TCN-542 (5079_A16), TCN-543 (5081_G23), TCN-544 (5082_A19), TCN-545 (5082_I15), TCN-546 (5089_L08), TCN-547 (5092_F11), TCN-548 (5092_P01), TCN-549 (5092_P04), TCN-550 (5096_F06), TCN-551 (5243_D01), TCN-552 (5249_I23), TCN-553 (5261_C18), TCN-554 (5277_M05), TCN-555 (5246_L16), TCN-556 (5089_K12), TCN-557 (5081_A04), TCN-558 (5248_H10b), TCN-559 (5097_G08), TCN-560 (5084_P10), and TCN-504 (3251_K17). These antibodies were initially isolated from human samples and are produced by the B cell cultures referred to as 3212_I12, 3280_D18, 5248_A17, 5237_B21, 5084_C17, 5086_C06, 5087_P17, 5297_H01, 5248_H10a, 5091_H13, 5262_H18, 5256_A17, 5249_B02, 5246_P19, 5095_N01, 3194_D21, 3206_O17, 5056_A08, 5060_F05, 5062_M11, 5079_A16, 5081_G23, 5082_A19, 5082_I15, 5089_L08, 5092_F11, 5092_P01, 5092_P04, 5096_F06, 5243_D01, 5249_I23, 5261_C18, 5277_M05, 5246_L16, 5089_K12, 5081_A04, 5248_H10b, 5097_G08, 5084_P10, and 3251_K17. These antibodies have broad neutralizing activity or broad binding activity for Influenza A in vitro.

The CDRs of the antibody heavy chains are referred to as CDRH1, CDRH2 and CDRH3, respectively. Similarly, the CDRs of the antibody light chains are referred to as CDRL1, CDRL2 and CDRL3, respectively. The position of the CDR amino acids is defined according to the IMGT numbering system as: CDR1—IMGT positions 27 to 38, CDR2—IMGT positions 56 to 65 and CDR3—IMGT positions 105 to 117. (Lefranc, M P. et al. 2003 IMGT unique numbering for immunoglobulin and T cell receptor variable regions and Ig superfamily V-like domains. Dev Comp Immunol. 27(1):55-77; Lefranc, M P. 1997. Unique database numbering system for immunogenetic analysis. Immunology Today, 18:509; Lefranc, M P. 1999. The IMGT unique numbering for Immunoglobulins, T cell receptors and Ig-like domains. The Immunologist, 7:132-136.)

The sequences of the antibodies were determined, including the sequences of the variable regions of the Gamma heavy and Kappa or Lambda light chains of the antibodies designated. In addition, the sequence of each of the polynucleotides and polypeptides encoding the antibody sequences was determined for TCN-522 (3212_I12), TCN-521 (3280_D18), TCN-523 (5248_A17), TCN-563 (5237_B21), TCN-526 (5084_C17), TCN-527 (5086_C06), TCN-528 (5087_P17), TCN-529 (5297_H01), TCN-530 (5248_H10a), TCN-531 (5091_H13), TCN-532 (5262_H18), TCN-533 (5256_A17), TCN-534 (5249_B02), TCN-535 (5246_P19), TCN-536 (5095_N01), TCN-537 (3194_D21), TCN-538 (3206_O17), TCN-539 (5056_A08), TCN-540 (5060_F05), TCN-541 (5062_M11), TCN-542 (5079_A16), TCN-543 (5081_G23), TCN-544 (5082_A19), TCN-545 (5082_I15), TCN-546 (5089_L08), TCN-547 (5092_F11), TCN-548 (5092_P01), TCN-549 (5092_P04), TCN-550 (5096_F06), TCN-551 (5243_D01), TCN-552 (5249_I23), TCN-553 (5261_C18), TCN-554 (5277_M05), TCN-555 (5246_L16), TCN-556 (5089_K12), TCN-557 (5081_A04), TCN-558 (5248_H10b), TCN-559 (5097_G08), TCN-560 (5084_P10), and TCN-504 (3251_K17).

Shown below are the polypeptide and polynucleotide sequences of the heavy and light chains, with the signal peptides at the N-terminus (or 5' end) and the constant regions at the C-terminus (or 3' end) of the variable regions, which are shown in bolded text.

```
TCN-504 (3251_K17) heavy chain variable region nucleotide sequence:
                                                              (SEQ ID NO: 745)
CAGGTGCAACTGCAGGAGTCGGGCCCAGGACTGGTGAAGCCCTCGGAGAGCCTGTCCCTCACTTGCGCTGTCTCT

GGTGTCTCCATCAGCAATATTGATTTCTACTGGGGCTGGATCCGCCAGCCCCCAGGGAAGGGGCTAGAATGGATT

GGCAATATCTATTATACGGGGATCACCTTCTACAACCCGTCCCTCAGCAGTCGAGTCGCCATATCCATTGACACC

TCCAAGAACCAGTTCTCCCTGACTCTGACTTCTGTGACCGCCGCAGACACGGCTATGTATTACTGTGCGAGACAT

TACGGTGACTCCGAGGCAATAAACGATGCCTTTGACATCTGGGGCCAAGGGACAATGCTCACCGTCTCGAGC

TCN-504 (3251_K17) gamma heavy chain variable region amino acid sequence:
(Kabat CDRs in bold, Chothia CDRs underlined)
                                                              (SEQ ID NO: 746)
QVQLQESGPGLVKPSETLSLTCAVSGVSISNIDFYWGWIRQPPGKGLEWIGNIYYTGITFYNPSLSSRV

AISIDTSKNQFSLTLTSVTAADTAMYYCARHYGDSEAINDAFDIWGQGTMLTVSS
```

TCN-504 (3251_K17) gamma heavy chain Kabat CDRs:
CDR 1:
(SEQ ID NO: 747)
NIDFYWG

CDR 2:
(SEQ ID NO: 748)
NIYYTGITFYNPSLSS

CDR 3:
(SEQ ID NO: 749)
HYGDSEAINDAFDI

TCN-504 (3251_K17) gamma heavy chain Chothia CDRs
CDR 1:
(SEQ ID NO: 750)
GVSISN

CDR 2:
(SEQ ID NO: 751)
NIYYTGITF

CDR 3:
(SEQ ID NO: 749)
HYGDSEAINDAFDI

TCN-504 (3251_K17) light chain variable region nucleotide sequence:
(SEQ ID NO: 752)
GAGATAGTGATGACGCAGTCTCCAGCCACCCTGTCTGTGTCTCCAGGGGAAAGAGCCACCCTCTCCTGCAGGGCC

AGTCAGAGTGTTGGCAATAGTTTAGCCTGGTACCAGCAGAGACCTGGCCAGGCTCCCAGGCTCCTCATCTACGGT

GCATCCACCAGGGCCACTGGTATCCCACCCAGGTTCAGTGGCAGTGGGTCTGGGACAGAATTCACTCTCACCATC

AGCAGCCTGCAGACTGAAGATTTTGCAGTTTATTACTGTCAACAATATATTAACTGGCGTCCGCTCAGTTTTGGC

GGAGGGACCAAGGTGGAGATCAAA

TCN-504 (3251_K17) light chain variable region amino acid sequence (KabatCDRs
in bold, Chothia CDRs underlined)
(SEQ ID NO: 753)
EIVMTQSPATLSVSPGERATLSCRASQSVGNSLAWYQQRPGQAPRLLIYGASTRATGIPPRFSGSGSGT

EFTLTISSLQTEDFAVYYCQQYINWRPLSFGGGTKVEIK

TCN-504 (3251_K17) light chain Kabat CDRs:
CDR 1:
(SEQ ID NO: 754)
RASQSVGNSLA

CDR 2:
(SEQ ID NO: 755)
GASTRAT

CDR 3:
(SEQ ID NO: 756)
QQYINWRPLS

TCN-504 (3251_K17) light chain Chothia CDRs:
CDR 1:
(SEQ ID NO: 754)
RASQSVGNSLA

CDR 2:
(SEQ ID NO: 755)
GASTRAT

CDR 3:
(SEQ ID NO: 756)
QQYINWRPLS

TCN-521 (3280_D18) heavy chain variable region nucleotide sequence:
(SEQ ID NO: 758)
GAAGTGCAGTTGGTGCAGTCTGGAGGAGGCTTGGTCCAGCCTGGGGGGTCCCTGAGACTCGCCTGTGTAGTCTCT

GGGTTCACCGTCACCAGCAATTATATAACTTGGGTCCGCCAGGCTCCAGGGAAGGGGCTGGAGTGGGTCTCAGTT

ATTTATAGTCATGGTCGCGCATATTATTCAGCCTCCGTGAATGGCCGATTCACCATCTCCAGACACACTTCCAAG

AACACAGTTTATCTTGAAATGAACAGCCTGAGACCTGAGGACACGGCCGTCTATTACTGTGCGGGCGGGGGCCTA

```
GTCGGTGGCTACGACGAATATTTCTTTGACTATTGGGGCCAGGGAACCCTGGCCACCGTCTCCTCA
```

TCN-521 (3280_D18) gamma heavy chain variable region amino acid sequence:
(Kabat CDRs in bold, Chothia CDRs underlined)

(SEQ ID NO: 759)

EVQLVQSGGGLVQPGGSLRLACVVS<u>GFTVT</u>SNYITWVRQAPGKGLEWVS<u>VIYSHGRAY</u>YSASVNGRF

TISRHTSKNTVYLEMNSLRPEDTAVYYCAGGGLVGGYDEYFFDYWGQGTLATVSS

TCN-521 (3280_D18) gamma heavy chain Kabat CDRs:
CDR 1:

(SEQ ID NO: 760)

SNYIT

CDR 2:

(SEQ ID NO: 761)

VIYSHGRAYYSASVNG

CDR 3:

(SEQ ID NO: 762)

GGLVGGYDEYFFDY

TCN-521 (3280_D18) gamma heavy chain Chothia CDRs:
CDR 1:

(SEQ ID NO: 763)

GFTVTS

CDR 2:

(SEQ ID NO: 764)

VIYSHGRAY

CDR 3:

(SEQ ID NO: 762)

GGLVGGYDEYFFDY

TCN-521 (3280_D18) light chain variable region nucleotide sequence:

(SEQ ID NO: 765)

```
GAAACTGTCTTGACGCAATCTCCAGGCACCTTGTCTTTGACTCCAGGGGAAAGAGCCACCCTCTCCTGCAGAGTC

GGTCAGAGTGTTAGCGGCAGCCACTTAGCCTGGTACCAACAGAAACCTGGCCAGGCTCCCAGGCTCCTCATCTAT

GGTGCATCCAGCAGGGCCACTGGCATCCCAGACAGGTTCGGTGGCAGTGTGTCTGGGACAGACTTCACTCTCACC

ATCAGCAGACTGGAGCCTGAAGATTCTGCAGTTTATTACTGTCAGCAGTATGGTGACTCACGATACACTTTTGGC

CAGGGGACCAAGCTGGAGATCAAA
```

TCN-521 (3280_D18) light chain variable region amino acid sequence (Kabat CDRs
in bold, Chothia CDRs underlined)

(SEQ ID NO: 766)

ETVLTQSPGTLSLTPGERATLSC<u>RVGQSVSGSHLA</u>WYQQKPGQAPRLLIY<u>GASSRAT</u>GIPDRFGGSVSG

TDFTLTISRLEPEDSAVYYCQQYGDSRYTFGQGTKLEIK

TCN-521 (3280_D18) Light chain Kabat CDRs:
CDR 1:

(SEQ ID NO: 767)

RVGQSVSGSHLA

CDR 2:

(SEQ ID NO: 768)

GASSRAT

CDR 3:

(SEQ ID NO: 769)

QQYGDSRYT

TCN-521 (3280_D18) Light chain Chothia CDRs:
CDR 1:

(SEQ ID NO: 767)

RVGQSVSGSHLA

CDR 2:

(SEQ ID NO: 768)

GASSRAT

CDR 3:

-continued

QQYGDSRYT (SEQ ID NO: 769)

TCN-522 (3212_I12) heavy chain variable region nucleotide sequence:
(SEQ ID NO: 770)
CAGGTGCAGCTACAGCAGTGGGGCGCAGGACTTTTGAAACCTTCGGAGACCCTGTCCCTCACCTGCACTGTGTCT

GGGGGGTCCCTCACTGATTACTCTTGGAACTGGATCCGCCAGCCCCCAGGGAAGGGGCTGGAGTGGATCGGTGAC

ACCCTTCATAATGGCTACACCAACTACAACCCGTCCCTCAGGGGTCGAGTTTCCATCTCAATAGACACGTCCAAG

AACCAGGTCTCACTCAGGCTGACCTCTGTGACCGCCGCGGACACGGCTCTTTATTACTGTGCGAGAGGCTCAGGT

GGATATGGTGGCTTCGATTATTTTGGCAAGCTCCGGACATGGGACTTCTGGGGCCAGGGAACGCTGGTCACCGTC

TCCTCA

TCN-522 (3212_I12) gamma heavy chain variable region amino acid sequence:
(Kabat CDRs in bold, Chothia CDRs underlined)
(SEQ ID NO: 771)
QVQLQQWGAGLLKPSETLSLTCTVS<u>GGSLTDYSWN</u>WIRQPPGKGLEWIGDTLHNGYTNYNPSLRGR

VSISIDTSKNQVSLRLTSVTAADTALYYCARGSGGYGGFDYFGKLRTWDFWGQGTLVTVSS

TCN-522 (3212_I12) gamma heavy chain Kabat CDRs:
CDR 1:
(SEQ ID NO: 772)
DYSWN

CDR 2:
(SEQ ID NO: 773)
DTLHNGYTNYNPSLRG

CDR 3:
(SEQ ID NO: 774)
GSGGYGGFDYFGKLRTWDF

TCN-522 (3212_I12) gamma heavy chain Chothia CDRs:
CDR 1:
(SEQ ID NO: 775)
GGSLTD

CDR 2:
(SEQ ID NO: 776)
DTLHNGYTN

CDR 3:
(SEQ ID NO: 774)
GSGGYGGFDYFGKLRTWDF

TCN-522 (3212_I12) light chain variable region nucleotide sequence:
(SEQ ID NO: 777)
GACATTCAGTTGACCCAGTCTCCATCCTCCCTGTCTGCATCTGTGGGAGACAGAGTCACCATCACTTGCCGGGCA

AGTCAGGGCATTAGAAATGATTTAGGCTGGTATCAGCAAAAACCAGGGAACGCCCCTAAGCGCCTGATCTTTGGT

GCATCCAGTTTGCAAAGTGGGGTCCCATCAAGGTTCAGCGGCAGTGGATCTGGGACAGAGTTCACTCTCACAATC

AGCAGCCTGCAGCCTGAGGACTTTGCAACTTATTACTGTCTACAGCATAATAGTTACCCGTACACTTTTGGCCAG

GGGACCAAGCTGGAGATCAAG

TCN-522 (3212_I12) light chain variable region amino acid sequence (Kabat CDRs
in bold, Chothia CDRs underlined)
(SEQ ID NO: 778)
DIQLTQSPSSLSASVGDRVTITC<u>RASQGIRNDLG</u>WYQQKPGNAPKRLIF<u>GASSLQS</u>GVPSRFSGSGSGT EFTLTISSLQPEDFATYYC<u>LQHNSYPYT</u>FGQGTKLEIK TCN-522 (3212_I12) Light chain Kabat CDRs:
CDR 1:
(SEQ ID NO: 779)
RASQGIRNDLG

CDR 2:
(SEQ ID NO: 780)
GASSLQS

CDR 3:

-continued

LQHNSYPYT
(SEQ ID NO: 781)

TCN-522 (3212_I12)Light chain Chothia CDRs
CDR 1:
(SEQ ID NO: 779)
RASQGIRNDLG

CDR 2:
(SEQ ID NO: 780)
GASSLQS

CDR 3:
(SEQ ID NO: 781)
LQHNSYPYT

TCN-523 (5248_A17) heavy chain variable region nucleotide sequence:
(SEQ ID NO: 782)
CAGGTGCAACTGGTGCAGTCTGGGGCTGAGGTGAAGAAGCCTGGGTCCTCGGTGAAGGTCTCCTGCAAGGCTTCT

GGAGGCAGCTTCAGCAACTATGCCTTCAGCTGGGTGCGACAGGCCCCTGGACAAGGGCTTGAGTGGATGGGAGGG

ACCATCCCTCTACTTGGTACAACAAACTACGCACAGAAGTTCCAGGGCAGAGTCACGATTT CCGCGGACCAATTC

ACGAGCACAGCCTACATGGAGCTGGGCAGCCTGAGATCTGAAGACACGGCCGTGTATTACTGTACGAGACGGAAA

ATGACTACGGCTTTTGACTCCTGGGGCCAGGGAACCCTGGTCACCGTCTCCTCA

TCN-523 (5248_A17) gamma heavy chain variable region amino acid sequence:
(Kabat CDRs in bold, Chothia CDRs underlined)
(SEQ ID NO: 783)
QVQLVQSGAEVKKPGSSVKVSCKASGGSFS<u>NYAFS</u>WVRQAPGQGLEWMG<u>GTIPLLGTTN</u>YAQKFQ

GRVTISADQFTSTAYMELGSLRSEDTAVYYCTR<u>RKMTTAFDS</u>WGQGTLVTVSS

TCN-523 (5248_A17) gamma heavy chain Kabat CDRs:
CDR 1:
(SEQ ID NO: 784)
NYAFS

CDR 2:
(SEQ ID NO: 785)
GTIPLLGTTNYAQKFQG

CDR 3:
(SEQ ID NO: 786)
RKMTTAFDS

TCN-523 (5248_A17)gamma heavy chain Chothia CDRs:
CDR 1:
(SEQ ID NO: 787)
GGSFSN

CDR 2:
(SEQ ID NO: 788)
GTIPLLGTTN

CDR 3:
(SEQ ID NO: 786)
RKMTTAFDS

TCN-523 (5248_A17)light chain variable region nucleotide sequence:
(SEQ ID NO: 789)
CAGCCTGTTCTGACTCAGCCACCTTCTGCATCAGCCTCCCTGGGAGCCTCGGTCACACTCACCTGCACCCTGAGC

AGCGCCTACAGTAATTATAAAGTGGACTGGTACCAGCAGAGACCAGGGAAGGGCCCCCGCTTTGTGATGCGAGTG

GGCACTGGTGGGATTGTGGGATCCAAGGGGGATGGCATCCCTGATCGCTTCTCAGTCTTGGGCTCAGGCCTGAAT

CGGTACCTGACCATCAAGAACATCCAGGAAGAGGATGAGAGTGACTACCACTGTGGGGCAGACCATGGCAGTGGG

AGCAACTTCGTGTCCCCTTACGTATTCGGCGGAGGGACCAAGCTGACCGTTCTA

TCN-523 (5248_A17)light chain variable region amino acid sequence (Kabat CDRs
in bold, Chothia CDRs underlined)
(SEQ ID NO: 790)
QPVLTQPPSASASLGASVTLTC<u>TLSSAYSNYKVD</u>WYQQRPGKGPRFVMR<u>VGTGGIVGSKGD</u>GIPDRF SVLGSGLNRYLTIKNIQEEDESDYHC<u>GADHGSGSNFVSPYV</u>FGGGTKLTVL TCN-523 (5248_A17)Light chain Kabat CDRs:

-continued

CDR 1:
(SEQ ID NO: 791)
TLSSAYSNYKVD

CDR 2:
(SEQ ID NO: 792)
VGTGGIVGSKGD

CDR 3:
(SEQ ID NO: 793)
GADHGSGSNFVSPYV

TCN-523 (5248_A17)Light chain Chothia CDRs:
CDR 1:
(SEQ ID NO: 791)
TLSSAYSNYKVD

CDR 2:
(SEQ ID NO: 792)
VGTGGIVGSKGD

CDR 3:
(SEQ ID NO: 793)
GADHGSGSNFVSPYV

TCN-563 (5237_B21) heavy chain variable region nucleotide sequence:
(SEQ ID NO: 794)
CAGGTGCAGCTGGCGCAGTCTGGGGCTGAGGTGAAGAGGCCTGGGTCCTCGGTGAAAGTCTCATGCACGGCTTCT

GGAGGCATCTTCAGGAAGAATGCAATCAGCTGGGTGCGACAGGCCCCTGGACAAGGCCTTGAGTGGATGGGAGGG

ATCATCGCAGTCTTTAACACAGCAAATTACGCGCAGAAGTTTCAGGGCAGAGTCAAAATTACCGCAGACGAATCC

GGGAATACAGCCTACATGGAGCTGAGCAGCCTGAGATCTGACGACACGGCCGTGTATTACTGTGCGAGTCACCCA

AAATATTTCTATGGTTCGGGGAGTTATCCGGACTTCTGGGGCCAGGGAACCCTGGTCACCGTCTCGAGC

TCN-563 (5237_B21) gamma heavy chain variable region amino acid sequence:
(Kabat CDRs in bold, Chothia CDRs underlined)
(SEQ ID NO: 795)
QVQLAQSGAEVKRPGSSVKVSCTAS<u>GGIFRKNAIS</u>WVRQAPGQGLEWMG<u>GIIAVFNTANYAQKFQG</u>

RVKITADESGNTAYMELSSLRSDDTAVYYCASHPKYFYGSGSYPDFWGQGTLVTVSS

TCN-563 (5237_B21)gamma heavy chain Kabat CDRs:
CDR 1:
(SEQ ID NO: 796)
KNAIS

CDR 2:
(SEQ ID NO: 797)
GIIAVFNTANYAQKFQG

CDR 3:
(SEQ ID NO: 798)
HPKYFYGSGSYPDF

TCN-563 (5237_B21)gamma heavy chain Chothia CDRs:
CDR 1:
(SEQ ID NO: 799)
GGIFRK

CDR 2:
(SEQ ID NO: 800)
GIIAVFNTAN

CDR 3:
(SEQ ID NO: 798)
HPKYFYGSGSYPDF

TCN-563 (5237_B21)light chain variable region nucleotide sequence:
(SEQ ID NO: 801)
CAATCTGCCCTGACTCAGCCTCGCTCAGTGTCCGGGTCTCCTGGACAGTCAGTCACCATCTCCTGCACTGGAAGC

AGCAGTGATGTTGGTGCTTCTAACTCTGTCTCCTGGTACCAACAACACCCAGGCAAAGCCCCCAAACTCGTTATT

TATGATGTCACTGAGCGACCCTCAGGGGTCCCTCATCGCTTCTCTGGCTCCAAGTCTGGCAACACGGCCTCCCTG

ACCGTCTCTGGGCTCCAGCCTGAGGACGAGGCTGATTATTTCTGCTGCGCATATGGAGGCAAATATCTTGTGGTC

TTCGGCGGAGGGACCAAGGTGACCGTCCTC

TCN-563 (5237_B21)light chain variable region amino acid sequence (Kabat CDRs in bold, Chothia CDRs underlined)

(SEQ ID NO: 802)
QSALTQPRSVSGSPGQSVTISCTGSSSDVGASNSVSWYQQHPGKAPKLVIYDVTERPSGVPHRFSGSKS

GNTASLTVSGLQPEDEADYFCCAYGGKYLVVFGGGTKVTVL

TCN-563 (5237_B21)light chain Kabat CDRs:
CDR 1:
(SEQ ID NO: 803)
TGSSSDVGASNSVS

CDR 2:
(SEQ ID NO: 804)
DVTERPS

CDR 3:
(SEQ ID NO: 805)
CAYGGKYLVV

TCN-563 (5237_B21)light chain Chothia CDRs:
CDR 1:
(SEQ ID NO: 803)
TGSSSDVGASNSVS

CDR 2:
(SEQ ID NO: 804)
DVTERPS

CDR 3:
(SEQ ID NO: 805)
CAYGGKYLVV

TCN-526 (5084_C17)heavy chain variable region nucleotide sequence:
(SEQ ID NO: 806)
GAGGTGCTGATGGTGGAGTCTGGGGGAGGCTTGGTCCAGCCTGGGGGGTCCGTGAGACTCTCCTGTGTAGCCTCT

GGATTCAGTTTCAGTAGTCATTGGATGACCTGGGTCCGCCAGGCTCCAGGGAAGGGGCTGGAGTGGGTGGCCAAC

ATAGAGGACGATGGAGGTGACAAGTACTATGTGGACTCTGTGAAGGGCCGATTCATTATCTCCAGAGACAACGCC

AAGAATTCAGTGTATCTGCAAATGAACAGCCTAAGAGCCGAGGACACGGCTGTGTATTTCTGTGCGAGAGGTTCG

GGGAGCTCTGATAGAAGTGATTATGACCCCCACTACTACTACTACTTGGACGTCTGGGGCAAAGGGGCCACGGTC

ACCGTCTCCTCA

TCN-526 (5084_C17) gamma heavy chain variable region amino acid sequence:
(Kabat CDRs in bold, Chothia CDRs underlined)
(SEQ ID NO: 807)
EVLMVESGGGLVQPGGSVRLSCVAS<u>GFSFSS</u>SHWMTWVRQAPGKGLEWVANIEDDGGDKYYVDSVK

GRFIISRDNAKNSVYLQMNSLRAEDTAVYFCARGSGSSDRSDYDPHYYYYLDVWGKGATVTVSS

TCN-526 (5084_C17) gamma heavy chain Kabat CDRs:
CDR 1:
(SEQ ID NO: 808)
SHWMT

CDR 2:
(SEQ ID NO: 809)
NIEDDGGDKYYVDSVKG

CDR 3:
(SEQ ID NO: 810)
GSGSSDRSDYDPHYYYYLDV

TCN-526 (5084_C17) gamma heavy chain Chothia CDRs:
CDR 1:
(SEQ ID NO: 811)
GFSFSS

CDR 2:
(SEQ ID NO: 812)
NIEDDGGDKY

CDR 3:

-continued

GSGSSDRSDYDPHYYYYLDV (SEQ ID NO: 810)

TCN-526 (5084_C17) light chain variable region nucleotide sequence:
(SEQ ID NO: 813)
GACATCCAGCTGACCCAGTCTCCATCTTCCCTGTCTGCATCTGTAGGAGACAGAGTCACCATCACTTGCCGGGCA

AGTCAGAGCATTAGTAGGTATTTAAATTGGTATCAGCAAAAACCAGGGAAAGCCCCTAAGCTCCTGCTGTTTGCT

GCTTCTACTTTGCTAGATGGGGTCCCATCAAGATTCAGTGGCAGTGGATCTGGGACAGATTTCACTCTCACCATC

AGCAGTCTGCAACCTGAAGATTTTGCAACTTACTACTGTCAACGGAATCACAGTCCCTCGTGGACGTTCGGCCAA

GGGACCAGGGTGGAAATCAAA

TCN-526 (5084_C17) light chain variable region amino acid sequence (Kabat CDRs
in bold, Chothia CDRs underlined)
(SEQ ID NO: 814)
DIQLTQSPSSLSASVGDRVTITCRASQSISRYLNWYQQKPGKAPKLLLFAASTLLDGVPSRFSGSGSGT

DFTLTISSLQPEDFATYYCQRNHSPSWTFGQGTRVEIK

TCN-526 (5084_C17) Light chain Kabat CDRs:
CDR 1:
(SEQ ID NO: 815)
RASQSISRYLN

CDR 2:
(SEQ ID NO: 816)
AASTLLD

CDR 3:
(SEQ ID NO: 817)
QRNHSPSWT

TCN-526 (5084_C17) Light chain Chothia CDRs:
CDR 1:
(SEQ ID NO: 815)
RASQSISRYLN

CDR 2:
(SEQ ID NO: 816)
AASTLLD

CDR 3:
(SEQ ID NO: 817)
QRNHSPSWT

TCN-527 (5086_C06) heavy chain variable region nucleotide sequence:
(SEQ ID NO: 818)
CAGGTGCAGCTGCAAGAGTCGGGCCCGGGACTGGTGAAGCCTTCGGAGACCCTGTCCCTCAACTGCGCTGTCTCT

GGAGGCTCCATCAGTAATTACTACTGGAGCTGGATCCGGCAGCCCCCCGGGAAGGGACTGGAGTGGATTGGCTAT

ATCTCTTACAATGGGAGGCCCAAGTACAACCCCTCCCTCACGAGTCGAGTCACCATATCCGTCGACACGTCCAAG

GACCAGTTCTCCCTGGAGCTGCGCTCTGTGACCGCTGCGGACACGGCCCTTTATTACTGTGCGAGAGAAACGCGG

TTCGGGGAGTTATTATCTCCCTATGATGCTTTTGAAATCTGGGGCCAAGGGACAATGGTCACCGTCTCCTCA

TCN-527 (5086_C06) gamma heavy chain variable region amino acid sequence:
(Kabat CDRs in bold, Chothia CDRs underlined)
(SEQ ID NO: 819)
QVQLQESGPGLVKPSETLSLNCAVS<u>GGSISNYYWS</u>WIRQPPGKGLEWIGYISYNGRPKYNPSLTSRVTI

SVDTSKDQFSLELRSVTAADTALYYCARETRFGELLSPYDAFEIWGQGTMVTVSS

TCN-527 (5086_C06) gamma heavy chain Kabat CDRs:
CDR 1:
(SEQ ID NO: 820)
NYYWS

CDR 2:
(SEQ ID NO: 821)
YISYNGRPKYNPSLTS

CDR 3:

ETRFGELLSPYDAFEI (SEQ ID NO: 822)

TCN-527 (5086_C06) gamma heavy chain Chothia CDRs:
CDR 1:

GGSISN (SEQ ID NO: 824)

CDR 2:

YISYNGRPK (SEQ ID NO: 823)

CDR 3:

ETRFGELLSPYDAFEI (SEQ ID NO: 822)

TCN-527 (5086_C06) light chain variable region nucleotide sequence:
(SEQ ID NO: 825)
GACATCCAGATGACCCAGTCTCCATCCTCCCTGTCTGCATCTGTAGGAGACAGAGTCACCATGACTTGCCGGGCA

AGTCAGAACATTAGAAGCTATTTAAATTGGTATCAGCAGAGACCAGGGACAGCCCCTAAACTCCTGATCTATGCT

GCATCCACTTTACACAGTGGGGTCCCATCAAGGTTCAGTGGCGGTGGGTCTGGGACAGATTTCACTCTCACCATC

AATAATCTGCAACCTGAAGATTTTGCATCTTACTACTGTCAACAGAGTTACGATAACCCTCAGACGTTCGGCCAA

GGGACCAAGGTGGAAATCAAA

TCN-527 (5086_C06) light chain variable region amino acid sequence (Kabat CDRs
in bold, Chothia CDRs underlined)
(SEQ ID NO: 826)
DIQMTQSPSSLSASVGDRVTMTCRASQNIRSYLNWYQQRPGTAPKLLIYAASTLHSGVPSRFSGGGSG

TDFTLTINNLQPEDFASYYCQQSYDNPQTFGQGTKVEIK

TCN-527 (5086_C06) Light chain Kabat CDRs:
CDR 1:

RASQNIRSYLN (SEQ ID NO: 827)

CDR 2:

AASTLHS (SEQ ID NO: 828)

CDR 3:

QQSYDNPQT (SEQ ID NO: 829)

TCN-527 (5086_C06) Light chain Chothia CDRs:
CDR 1:

RASQNIRSYLN (SEQ ID NO: 827)

CDR 2:

AASTLHS (SEQ ID NO: 828)

CDR 3:

QQSYDNPQT (SEQ ID NO: 829)

TCN-528 (5087_P17) heavy chain variable region nucleotide sequence:
(SEQ ID NO: 830)
CAGGTGCAGCTGGTGCAGTCTGGGTCTGAGGTGAAGAAGCCTGGGGCCTCAGTGAAGGTCTCCTGCAAGGCTTCT

GGATACACCTTCACCAATTATGACATCAACTGGATTCGACAGGCCCCTGGTCAAGGACTTGAGTGGATGGGCTGG

ATAAATCCCAACAGTGGAACCACGGGCTCTGCACAGAGGTTCCAGGGCAGAGTCACCATAACCGTGGACACCTCC

ATAACCACAGTCTACATGGAACTGAGCAGCCTGAGATCTGACGACACGGCCATTTACTACTGCGCGAGAGGCCGT

GAGCTCCTCCGGCTTCAACATTTTTTGACTGACTCCCAGTCCGAGAGGAGGGACTGCTTCGACCCCTGGGGCCAG

GGAACCCTGGTCACCGTCTCCTCA

TCN-528 (5087_P17) gamma heavy chain variable region amino acid sequence:
(Kabat CDRs in bold, Chothia CDRs underlined)

-continued (SEQ ID NO: 831)
QVQLVQSGSEVKKPGASVKVSCKASGYTFT<u>NYDIN</u>WIRQAPGQGLEWMG<u>WINPNSGTTG</u>SAQRFQG

RVTITVDTSITTVYMELSSLRSDDTAIYYCARGRELLRLQHFLTDSQSERRDCFDPWGQGTLVTVSS

TCN-528 (5087_P17) gamma heavy chain Kabat CDRs:
CDR 1:
(SEQ ID NO: 832)
NYDIN

CDR 2:
(SEQ ID NO: 833)
WINPNSGTTGSAQRFQG

CDR 3:
(SEQ ID NO: 834)
GRELLRLQHFLTDSQSERRDCFDP

TCN-528 (5087_P17) gamma heavy chain Chothia CDRs:
CDR 1:
(SEQ ID NO: 835)
GYTFTN

CDR 2:
(SEQ ID NO: 836)
WINPNSGTTG

CDR 3:
(SEQ ID NO: 834)
GRELLRLQHFLTDSQSERRDCFDP

TCN-528 (5087_P17) light chain variable region nucleotide sequence:
(SEQ ID NO: 837)
GATATCCAGATGACCCAGTCTCCTTCCTCCCTGTCTGCATCTGTAGGAGACAGAGTCACCATCACTTGCCGGGCA

AATCAAGACATTGGCATTTATTTAAATTGGTATCAACAGAATCCAGGGAAAGTCCCTAAACTCCTGCTCCATGGT

GCGTCCAGTTTGCAGGGCGGGGTCCCATCAAGGTTCAGTGCCAGTGGATCTGGGACAGATTTCACTCTCACCATT

CACAGTCTACAACCTGAAGATTTAGCAACCTACTACTGTCAACAGAGTCGCCGTCTACCGTACACTTTTGGCCAG

GGGACCAGGGTGGAACTCAAA

TCN-528 (5087_P17) light chain variable region amino acid sequence (Kabat CDRs in bold, Chothia CDRs underlined)
(SEQ ID NO: 838)
DIQMTQSPSSLSASVGDRVTITC<u>RANQDIGIYLN</u>WYQQNPGKVPKLLLH<u>GASSLQG</u>GVPSRFSASGSG

TDFTLTIHSLQPEDLATYYCQQSRRLPYTFGQGTRVELK

TCN-528 (5087_P17) Light chain Kabat CDRs:
CDR 1:
(SEQ ID NO: 839)
RANQDIGIYLN

CDR 2:
(SEQ ID NO: 840)
GASSLQG

CDR 3:
(SEQ ID NO: 841)
QQSRRLPYT

TCN-528 (5087_P17) Light chain Chothia CDRs:
CDR 1:
(SEQ ID NO: 839)
RANQDIGIYLN

CDR 2:
(SEQ ID NO: 840)
GASSLQG

CDR 3:
(SEQ ID NO: 841)
QQSRRLPYT

TCN-529 (5297_H01) heavy chain variable region nucleotide sequence:
(SEQ ID NO: 842)
CAGATCACCTTGAGGGAGTCTGGTCCTACGCTGGTGAAACCCACACAGACCCTCACGCTGACCTGCACCTTCTCT

GGGTTTTCACTCAGCACTAATGGAGTGAATGTGGGCTGGATCCGTCAGCCCCCAGGAAAGGCCCTGGAGTGGCTT

```
GCACTCATTTACTGGGATGATGATAAGCGCTACAGTCCGTCTCTGAAGAGAAGGCTCACCATCACCAAGGACACC

TCCAAAAACCAAGTGGTCCTTACACTGACCAACATGGACCCTGTAGATACAGCCACATATTACTGTGCACACAGA

CCCGACTTCTATGGTGACTTCGAGTACTGGGGCCCGGGAACCCTGGTCACCGTCTCCTCA
```

TCN-529 (5297_H01) gamma heavy chain variable region amino acid sequence:
(Kabat CDRs in bold, Chothia CDRs underlined)

(SEQ ID NO: 843)
QITLRESGPTLVKPTQTLTLTCTFSGFSLS<ins>TNGVNVG</ins>WIRQPPGKALEWLA<ins>LIYWDDDKRYSPSLKR</ins>R LTITKDTSKNQVVLTLTNMDPVDTATYYCAH<ins>RPDFYGDFEY</ins>WGPGTLVTVSS TCN-529 (5297_H01) gamma heavy chain Kabat CDRs:
CDR 1:

(SEQ ID NO: 844)
TNGVNVG

CDR 2:

(SEQ ID NO: 845)
LIYWDDDKRYSPSLKR

CDR 3:

(SEQ ID NO: 846)
RPDFYGDFEY

TCN-529 (5297_H01) gamma heavy chain Chothia CDRs:
CDR 1:

(SEQ ID NO: 847)
GFSLSTNG

CDR 2:

(SEQ ID NO: 848)
LIYWDDDKR

CDR 3:

(SEQ ID NO: 846)
RPDFYGDFEY

TCN-529 (5297_H01) light chain variable region nucleotide sequence:

(SEQ ID NO: 849)
```
CAGTCTGCACTGACTCAGCCTGCCTCCGTGTCTGGGTCTCCCGGACAGTCGATCACCATCTCCTGCACTGGAAGC

AGCAGTGACATTGGTGGTTATAACTATGTCTCCTGGTACCAACAACACCCAGGCAAGGCCCCCAAACTCATGATT

TACGATGTCAATAATCGGCCCTCAGGGGTTTCTAATCGCTTCTCTGGCTCCAAGTCTGGCAACACGGCCTCCCTG

ACTATCTCTGGGCTCCAGACTGACGACGAGGCTGATTATTACTGCGGCTCATATACAGGCAGTCCTCATTATGTC

TTCGGAACTGGGACCAAGGTCACCGTCCTA
```

TCN-529 (5297_H01) light chain variable region amino acid sequence (Kabat CDRs
in bold, Chothia CDRs underlined)

(SEQ ID NO: 850)
QSALTQPASVSGSPGQSITISC<ins>TGSSSDIGGYNYVS</ins>WYQQHPGKAPKLMIY<ins>DVNNRPS</ins>GVSNRFSGSKS GNTASLTISGLQTDDEADYYC<ins>GSYTGSPHYV</ins>FGTGTKVTVL TCN-529 (5297_H01) Light chain Kabat CDRs:
CDR 1:

(SEQ ID NO: 851)
TGSSSDIGGYNYVS

CDR 2:

(SEQ ID NO: 852)
DVNNRPS

CDR 3:

(SEQ ID NO: 853)
GSYTGSPHYV

TCN-529 (5297_H01) Light chain Chothia CDRs:
CDR 1:

(SEQ ID NO: 851)
TGSSSDIGGYNYVS

CDR 2:

-continued

DVNNRPS (SEQ ID NO: 852)

CDR 3:

GSYTGSPHYV (SEQ ID NO: 853)

TCN-530 (5248_H10a) heavy chain variable region nucleotide sequence:
(SEQ ID NO: 854)
CAGGTCCAACTGGTGCAATCTGGGGCTGAGGTGAGGAAGCCTGGGTCCTCGGTGAAGGTCTCCTGCAAGGCTTCT

GGAGGCCCCTTCATGAGTTATGCTATCGGCTGGGTGCGACAGGCCCCTGGACAAGGGCTTGAGTGGATGGGAGGG

ATCAACCCTGTGTTTGGTAGACCGCACTACGCACAGAAGTTCCAGGGCAGAGTCACCATCGCCACGGACGACTCC

ACGAAGACATCGTACATGGAACTGAGTAGCCTGACGTCTGAGGACACGGGCATGTATTACTGTGCGAGTAGGTAT

AGTAGGTCGTCCCCAGGGACCTTTGAGTCCTGGGGCCAGGGAACCCTGGTCACCGTCTCGAGC

TCN-530 (5248_H10a) gamma heavy chain variable region amino acid sequence:
(Kabat CDRs in bold, Chothia CDRs underlined)
(SEQ ID NO: 855)
QVQLVQSGAEVRKPGSSVKVSCKAS<u>GGPFMSYAIG</u>WVRQAPGQGLEWMG<u>GINPVFGRPH</u>YAQKFQ

GRVTIATDDSTKTSYMELSSLTSEDTGMYYCASRYSRSSPGTFESWGQGTLVTVSS

TCN-530 (5248_H10a) gamma heavy chain Kabat CDRs:
CDR 1:
(SEQ ID NO: 856)
SYAIG

CDR 2:
(SEQ ID NO: 857)
GINPVFGRPHYAQKFQG

CDR 3:
(SEQ ID NO: 858)
RYSRSSPGTFES

TCN-530 (5248_H10a) gamma heavy chain Chothia CDRs:
CDR 1:
(SEQ ID NO: 859)
GGPFMS

CDR 2:
(SEQ ID NO: 860)
GINPVFGRPH

CDR 3:
(SEQ ID NO: 858)
RYSRSSPGTFES

TCN-530 (5248_H10a) light chain variable region nucleotide sequence:
(SEQ ID NO: 861)
GAAATAGTGATGACGCAGTTTCCAGCCACCCTGTCTGTGTCTCCCGGGGAACGAGTCACCCTCTCCTGTAGGGCC

AGTCAGAGTGTTAGCAACAATTTAGCCTGGTACCAGCAAAAACCTGGCCAGCCTCCCAGGCTCCTCATCTATGAT

GCATCTACCAGGGCCACGGGTGTCCCAGCCAAGTTCAGTGGCACTGGGTCTGGCACAGAGTTCACTCTCAGCATC

AGCAGCCTGCAGTCCGAAGATTTTGCAGTTTATTACTGTCAGCAGTATCACAACTGGCCTCCCTCGTACAGTTTT

GGCCTGGGGACCAAGCTGGAGATCAAA

TCN-530 (5248_H10a) light chain variable region amino acid sequence (Kabat CDRs
in bold, Chothia CDRs underlined)
(SEQ ID NO: 862)
EIVMTQFPATLSVSPGERVTLSC<u>RASQSVSNNLA</u>WYQQKPGQPPRLLIY<u>DASTRAT</u>GVPAKFSGTGSGT EFTLSISSLQSEDFAVYYC<u>QQYHNWPPSYS</u>FGLGTKLEIK TCN-530 (5248_H10a) Light chain Kabat CDRs:
CDR 1:
(SEQ ID NO: 863)
RASQSVSNNLA

CDR 2:
(SEQ ID NO: 864)
DASTRAT

CDR 3:
(SEQ ID NO: 865)
QQYHNWPPSYS

TCN-530 (5248_H10a) Light chain Chothia CDRs:
CDR 1:
(SEQ ID NO: 863)
RASQSVSNNLA

CDR 2:
(SEQ ID NO: 864)
DASTRAT

CDR 3:
(SEQ ID NO: 865)
QQYHNWPPSYS

TCN-531 (5091_H13) heavy chain variable region nucleotide sequence:
(SEQ ID NO: 866)
GAGGTGCAGCTGGTGGAGTCTGGGGGAGACTTGGTACAGCCAGGGCGGTCCCTGAAACTCTCCTGCACAGGTTCT

GGATTCACCTTTGGTGATTATGGTGTGACCTGGGTCCGCCAGGCTCCAGGGAAGGGGCTGGAGTGGGTAGGTTTC

ATTAGAACCAGACCTTGGGGTGGGACAGCAGATACCGCCGCGTCTGTGAAAGGCAGATTCACTATTTCAAGAGAT

GATTCCAAAAGTCTCGCCTATCTGCAAATGAACAGCCTGAAAACCGAGGACACAGCCGTGTATTACTGTTGTAGA

GATGCCCCTCCAAATGTGGAAGTGGCTTCTATGACCAACTGGTACTTCGATCTCTGGGGCCGTGGCACCCTGGTC

ACCGTCTCCTCA

TCN-531 (5091_H13) gamma heavy chain variable region amino acid sequence:
(Kabat CDRs in bold, Chothia CDRs underlined)
(SEQ ID NO: 867)
EVQLVESGGDLVQPGRSLKLSCTGS<u>GFTFGDYGVT</u>WVRQAPGKGLEWVGFIRTRPWGGTADTAASV

KGRFTISRDDSKSLAYLQMNSLKTEDTAVYYCCRDAPPNVEVASMTNWYFDLWGRGTLVTVSS

TCN-531 (5091_H13) gamma heavy chain Kabat CDRs:
CDR 1:
(SEQ ID NO: 868)
DYGVT

CDR 2:
(SEQ ID NO: 869)
FIRTRPWGGTADTAASVKG

CDR 3:
(SEQ ID NO: 870)
DAPPNVEVASMTNWYFDL

TCN-531 (5091_H13) gamma heavy chain Chothia CDRs:
CDR 1:
(SEQ ID NO: 871)
GFTFGD

CDR 2:
(SEQ ID NO: 872)
FIRTRPWGGTAD

CDR 3:
(SEQ ID NO: 870)
DAPPNVEVASMTNWYFDL

TCN-531 (5091_H13) light chain variable region nucleotide sequence:
(SEQ ID NO: 873)
GACATCCAGCTGACCCAGTCTCCATCCTCCCTGTCTGCATCTGTGGGAGACAGAGTCACCATCACTTGCCGGGCG

AGTCAGGGCATTCTCAATTGTTTAGCCTGGTATCAGCAGAAACCGGGGAAAGTTCCTAACCTCCTGATGTATGCT

GCATCCACATTGCAGTCAGGGGTCCCATCTCGGTTCAGCGGCAGTGGATTTGGGACAGATTTCACTCTCACCATC

AGCAGCCTGCAGCCTGAAGATGTTGCAACTTATTACTGTCAAACGTATGGCGGTGTCTCTACTTTCGGCGGAGGG

ACCAAGGTGGAGATCAGA

TCN-531 (5091_H13) light chain variable region amino acid sequence (Kabat CDRs
in bold, Chothia CDRs underlined)

```
                                                                (SEQ ID NO: 874)
DIQLTQSPSSLSASVGDRVTITCRASQGILNCLAWYQQKPGKVPNLLMYAASTLQSGVPSRFSGSGFG

TDFTLTISSLQPEDVATYYCQTYGGVSTFGGGTKVEIR

TCN-531 (5091_H13) Light chain Kabat CDRs:
CDR 1:
                                                                (SEQ ID NO: 875)
RASQGILNCLA CDR 2:
                                                                (SEQ ID NO: 876)
AASTLQS CDR 3:
                                                                (SEQ ID NO: 877)
QTYGGVST TCN-531 (5091_H13) Light chain Chothia CDRs:
CDR 1:
                                                                (SEQ ID NO: 875)
RASQGILNCLA CDR 2:
                                                                (SEQ ID NO: 876)
AASTLQS CDR 3:
                                                                (SEQ ID NO: 877)
QTYGGVST TCN-532 (5262_H18) heavy chain variable region nucleotide sequence:
                                                                (SEQ ID NO: 878)
CAGGTGCAGCTGCAGGAGTCGGGCCCAGGACTGGTGAAGCCTTCGGAGACCTTGTCCCTCACCTGCACTGTCTCT

GGTGGCTCCGTCAGCAGTGAGACTTACTACTGGAGCTGGATCCGGCAGCCCCCAGGGAAGGGACTAGAGTGGATT

GGATATATCTATTACATTGGGAACACCGACTACAGGCCCTCCCTCAAGAGTCGAGTCACCATATCACTGGACACG

TCCAAGAACCAGTTCTCCCTGAAGCTGAGCTCTGTGACCGCTGCGGACACGGCCGTTTATTACTGTGCGAGAGGC

GCTTATTATGATAGTAGTGGTTACCCGGCTTTTTATATCTGGGGCCAAGGGACAATGGTCACCGTCTCCTCA

TCN-532 (5262_H18) gamma heavy chain variable region amino acid sequence:
(Kabat CDRs in bold, Chothia CDRs underlined)
                                                                (SEQ ID NO: 879)
QVQLQESGPGLVKPSETLSLTCTVSGGSVSSETYYWSWIRQPPGKGLEWIGYIYYIGNTDYRPSLKSR

VTISLDTSKNQFSLKLSSVTAADTAVYYCARGAYYDSSGYPAFYIWGQGTMVTVSS

TCN-532 (5262_H18) gamma heavy chain Kabat CDRs:

CDR 1:
                                                                (SEQ ID NO: 880)
SETYYWS

CDR 2:
                                                                (SEQ ID NO: 881)
YIYYIGNTDYRPSLKS

CDR 3:
                                                                (SEQ ID NO: 882)
GAYYDSSGYPAFYI

TCN-532 (5262_H18) gamma heavy chain Chothia CDRs:
CDR 1:
                                                                (SEQ ID NO: 883)
GGSVSSET CDR 2:
                                                                (SEQ ID NO: 884)
YIYYIGNTD CDR 3:
                                                                (SEQ ID NO: 882)
GAYYDSSGYPAFYI TCN-532 (5262_H18) light chain variable region nucleotide sequence:
```

```
                                                           (SEQ ID NO: 885)
CAGTCTGTGCTGACGCAGCCGCCCTCAGTGTCTGGGGCCCCAGGGCAGAGGGTCACCATCTCCTGCACTGGGAGC

AGCTCCAACATCGGGTCAGATTATGATGTGCACTGGTACAAGCAACTTCCAGGAACAGCCCCCAAACTCCTCATC

TTTGGTAACAGCAATCGGCCCTCAGGGGTCCCTGACCGATTCTCTGGCTCCAAGTCTGGCACCTCAGCCTCCCTG

GCCATCACTGGGCTCCAGGCTGAGGATGAGGCTGATTATTACTGCCAATCCTATGACAGCAGCCTGAGTGGTTTT

CATGTCTTCGGAAGTGGGACCAAGGTCACCGTCCTA
```

TCN-532 (5262_H18) light chain variable region amino acid sequence (Kabat CDRs in bold, Chothia CDRs underlined)

```
                                                           (SEQ ID NO: 886)
QSVLTQPPSVSGAPGQRVTISCTGSSSNIGSDYDVHWYKQLPGTAPKLLIFGNSNRPSGVPDRFSGSKS

GTSASLAITGLQAEDEADYYCQSYDSSLSGFHVFGSGTKVTVL
```

TCN-532 (5262_H18) Light chain Kabat CDRs:
CDR 1:
```
                                                           (SEQ ID NO: 887)
TGSSSNIGSDYDVH
```

CDR 2:
```
                                                           (SEQ ID NO: 888)
GNSNRPS
```

CDR 3:
```
                                                           (SEQ ID NO: 889)
QSYDSSLSGFHV
```

TCN-532 (5262_H18) Light chain Chothia CDRs:
CDR 1:
```
                                                           (SEQ ID NO: 887)
TGSSSNIGSDYDVH
```

CDR 2:
```
                                                           (SEQ ID NO: 888)
GNSNRPS
```

CDR 3:
```
                                                           (SEQ ID NO: 889)
QSYDSSLSGFHV
```

TCN-533 (5256_A17) heavy chain variable region nucleotide sequence:
```
                                                           (SEQ ID NO: 890)
CAGGTGCAGCTGGTGCAGTCTGGGGCTGACGTGAAGAAGCCTGGGTCCTCGGTGACGGTCTCCTGCAAGGCTTCT

GGAGGCAGCTTCAGCAACTATGGAATCAACTGGGTGCGACAGGCCCCTGGACAAGGGCTTGAGTGGATGGGGGGA

ATCATCCCTCTCATTAATGCACCGAACTACGCACCGAAGTTCCAGGGCAGAGTGACGATTACCGCGGACATGTTC

TCGAATATAGTCTCCTTGCAGTTGACCAGCCTGAGAACTGACGACACGGCCGTGTATTATTGTGCGAGACGAAAA

ATGACTACGGCTATTGACTATTGGGGCCAGGGAACCCTGGTCACCGTCTCCTCA
```

TCN-533 (5256_A17) gamma heavy chain variable region amino acid sequence:
(Kabat CDRs in bold, Chothia CDRs underlined)
```
                                                           (SEQ ID NO: 891)
QVQLVQSGADVKKPGSSVTVSCKASGGSFSNYGINWVRQAPGQGLEWMGGIIPLINAPNYAPKFQG

RVTITADMFSNIVSLQLTSLRTDDTAVYYCARRKMTTAIDYWGQGTLVTVSS
```

TCN-533 (5256_A17) gamma heavy chain Kabat CDRs:
CDR 1:
```
                                                           (SEQ ID NO: 892)
NYGIN
```

CDR 2:
```
                                                           (SEQ ID NO: 893)
NAPNYAPKFQG
```

CDR 3:
```
                                                           (SEQ ID NO: 894)
RKMTTAIDY
```

TCN-533 (5256_A17) gamma heavy chain Chothia CDRs:
CDR 1:

-continued

GGSFSN
(SEQ ID NO: 787)

CDR 2:
(SEQ ID NO: 895)
GIIPLINAPN

CDR 3:
(SEQ ID NO: 894)
RKMTTAIDY

TCN-533 (5256_A17) light chain variable region nucleotide sequence:
(SEQ ID NO: 896)
CAGCCTGTGTTGAGTCAGCCACCTTCTGCATCGGCCTCCCTGGGAGCCTCCGTCACACTCACCTGCAC

CCTGAGTAGCGGCTTCGATAATTATCAAGTGGCCTGGTACCAGCAGAGACCAGGGAAGGGCCCCCGCT

TTGTGATGCGGGTGGGCAATGGTGGGAATGTGGCTTCCAAGGGGGATGGCATTCCTGATCGTTTCTCA

GTCTCGGGCTCAGGCCTGAATCGGTACCTGACCATCAAGAACATCCAGGAAGACGATGAGAGTGACTA

TTATTGTGGGGCAGACCATGGCAGTGGGAACAACTTCGTGTCCCCTTATGTGTTTGGCGGAGGGACCA

AGCTGACCGTTCTA

TCN-533 (5256_A17) light chain variable region amino acid sequence (Kabat CDRs
in bold, Chothia CDRs underlined)
(SEQ ID NO: 897)
QPVLSQPPSASASLGASVTLTCTLSSGFDNYQVAWYQQRPGKGPRFVMRVGNGGNVASKG

DGIPDRFSVSGSGLNRYLTIKNIQEDDESDYYCGADHGSGNNFVSPYVFGGGTKLTVL

TCN-533 (5256_A17) Light chain Kabat CDRs:
CDR 1:
(SEQ ID NO: 898)
TLSSGFDNYQVA

CDR 2:
(SEQ ID NO: 899)
VGNGGNVASKGD

CDR 3:
(SEQ ID NO: 900)
GADHGSGNNFVSPYV

TCN-533 (5256_A17) Light chain Chothia CDRs:
CDR 1:
(SEQ ID NO: 898)
TLSSGFDNYQVA

CDR 2:
(SEQ ID NO: 899)
VGNGGNVASKGD

CDR 3:
(SEQ ID NO: 900)
GADHGSGNNFVSPYV

TCN-534 (5249_B02) heavy chain variable region nucleotide sequence:
(SEQ ID NO: 901)
CAGGTCCAGCTGGTGCAGTCTGGGGCTGAGGTGAAGAAGCCAGGGTCCTCGGTGAAGGTCTCCTGCAGGGAATCT

GGAGGCACCTTCAACGGCTACACTATCACCTGGGTGCGACAGGCCCCTGGGCAAGGCCTTGAGTGGATGGGAGGG

ATCATCCCTATGATGGGGACAGTCAACTACGCACAGAAGTTGCAGGGCAGAGTCACCATTACCACGGACTATTTC

ACGAAAACAGCCTACATGGATCTGAACAATTTAAGATCTGAAGACACGGCCATGTATTATTGTGTGAAAATCAGA

TATACTGGGCAGCAGCTGCTCTGGGGCCAGGGAACCCTGGTCACCGTCTCCTCA

TCN-534 (5249_B02) gamma heavy chain variable region amino acid sequence:
(Kabat CDRs in bold, Chothia CDRs underlined)
(SEQ ID NO: 902)
QVQLVQSGAEVKKPGSSVKVSCRES<u>GGTFN</u>GYTITWVRQAPGQGLEWMGGIIPMMGTVNYAQKLQ

GRVTITTDYFTKTAYMDLNNLRSEDTAMYYCVKIRYTGQQLLWGQGTLVTVSS

TCN-534 (5249_B02) gamma heavy chain Kabat CDRs:
CDR 1:

-continued

```
GYTIT
```
(SEQ ID NO: 903)

CDR 2:
```
GIIPMMGTVNYAQKLQG
```
(SEQ ID NO: 904)

CDR 3:
```
IRYTGQQLL
```
(SEQ ID NO: 905)

TCN-534 (5249_B02) gamma heavy chain Chothia CDRs:
CDR 1:
```
GGTFNG
```
(SEQ ID NO: 906)

CDR 2:
```
GIIPMMGTVN
```
(SEQ ID NO: 907)

CDR 3:
```
IRYTGQQLL
```
(SEQ ID NO: 905)

TCN-534 (5249_B02) light chain variable region nucleotide sequence:
(SEQ ID NO: 908)
```
GACATCCAGATGACCCAGTCTCCTTCCACCCTGTCGGCATCTATAGGAGACAGAGTCACCATCACTTGCCGGGCC

AGTCAGAGTATTGCAAGTTGGTTGGCCTGGTATCAGCAAAAACCAGGGAAAGCCCCTAAGCTCCTGATCTATGAG

GCAGTTAATTTAGAAAGTGGGGTCCCATCAAGGTTCAGCGGCAGTGGATCTGGGACAGATTTCACTCTCACCATC

AGCAGCCTGCAGCCCGATGATTTTGCAACTTATTTCTGCCAACATTATGGTACTATTTCTCAGACCTTCGGCGGA

GGGACCAAGGTGGAGATCAAA
```

TCN-534 (5249_B02) light chain variable region amino acid sequence (Kabat CDRs
in bold, Chothia CDRs underlined)
(SEQ ID NO: 909)
DIQMTQSPSTLSASIGDRVTITCRASQSIASWLAWYQQKPGKAPKLLIYEAVNLESGVPSRFSGSGSGT

DFTLTISSLQPDDFATYFCQHYGTISQTFGGGTKVEIK

TCN-534 (5249_B02) Light chain Kabat CDRs:
CDR 1:
```
RASQSIASWLA
```
(SEQ ID NO: 910)

CDR 2:
```
EAVNLES
```
(SEQ ID NO: 911)

CDR 3:
```
QHYGTISQT
```
(SEQ ID NO: 912)

TCN-534 (5249_B02) Light chain Chothia CDRs:
CDR 1:
```
RASQSIASWLA
```
(SEQ ID NO: 910)

CDR 2:
```
EAVNLES
```
(SEQ ID NO: 911)

CDR 3:
```
QHYGTISQT
```
(SEQ ID NO: 912)

TCN-535 (5246_P19) heavy chain variable region nucleotide sequence:
(SEQ ID NO: 913)
```
CAGGTCCAGCTGGTGCAATCTGGGAGTGAGGTGAAGAAGCCTGGGACCTCGGTGAAGGTCTCCTGCACGGCCTCT

GGAAGTGTCTTCACCAATTATGGAATTAGTTGGGTGCGACAGGCCCCTGGACAAGGGCTTGAGTGGATGGGAGGG

ATCATCCCTCTCTTTGGCGCAGCCAAGTACGCACAGAAATTCCAGGGCAGAGTCACCATCACAGCGGACGAATCC

ACGAAGACAGTCTATATGGAGCTGAGCAGGCTGACATCTAAAGACACGGCCATATATTTCTGTGCGAAGGCCCCC

CGTGTCTACGAGTACTACTTTGATCAGTGGGGCCAGGGAACCCCAGTCACCGTCTCCTCA
```

-continued

TCN-535 (5246_P19) gamma heavy chain variable region amino acid sequence:
(Kabat CDRs in bold, Chothia CDRs underlined)

(SEQ ID NO: 914)
QVQLVQSGSEVKKPGTSVKVSCTAS<u>GSVFT</u>NYGISWVRQAPGQGLEWMG<u>GIIPLFGAAK</u>YAQKFQG

RVTITADESTKTVYMELSRLTSKDTAIYFCAK<u>APRVYEYYFDQ</u>WGQGTPVTVSS

TCN-535 (5246_P19) gamma heavy chain Kabat CDRs:
CDR 1:

(SEQ ID NO: 915)
NYGIS

CDR 2:

(SEQ ID NO: 916)
GIIPLFGAAKYAQKFQG

CDR 3:

(SEQ ID NO: 917)
APRVYEYYFDQ

TCN-535 (5246_P19) gamma heavy chain Chothia CDRs:
CDR 1:

(SEQ ID NO: 918)
GSVFTN

CDR 2:

(SEQ ID NO: 919)
GIIPLFGAAK

CDR 3:

(SEQ ID NO: 917)
APRVYEYYFDQ

TCN-535 (5246_P19) light chain variable region nucleotide sequence:

(SEQ ID NO: 920)
GAAATTGTGTTGACGCAGTCTCCAGGCACCCTGTCTTTGTCTCCAGGGGAAAGAGCCACCCTCTCCTGCAGGGCC

AGTCAGAGTGTTAGCAGCAGTCAATTAGCCTGGTACCAGCAAAAACCTGGCCAGGCTCCCAGGCTCATCATCTAT

GGTGCGTCCACCAGGGCCACTGGCATCCCAGACAGGTTCAGTGGAAGTGGGTCTGGGACAGACTTCACTCTCACC

ATCGGCAGACTGGAGCCTGAAGATTTTGCAGTGTTTTTCTGTCAGCAGTATAGTACCTCACCTCCGACGTTCGGC

CAAGGGACCAAGGTGGATTTCAAA

TCN-535 (5246_P19) light chain variable region amino acid sequence (Kabat CDRs
in bold, Chothia CDRs underlined)

(SEQ ID NO: 921)
EIVLTQSPGTLSLSPGERATLSC<u>RASQSVSSSQLA</u>WYQQKPGQAPRLIIY<u>GASTRAT</u>GIPDRFSGSGSGT

DFTLTIGRLEPEDFAVFFC<u>QQYSTSPPT</u>FGQGTKVIDEK

TCN-535 (5246_P19) Light chain Kabat CDRs:
CDR 1:

(SEQ ID NO: 922)
RASQSVSSSQLA

CDR 2:

(SEQ ID NO: 755)
GASTRAT

CDR 3:

(SEQ ID NO: 923)
QQYSTSPPT

TCN-535 (5246_P19) Light chain Chothia CDRs:
CDR 1:

(SEQ ID NO: 922)
RASQSVSSSQLA

CDR 2:

(SEQ ID NO: 755)
GASTRAT

CDR 3:

(SEQ ID NO: 923)
QQYSTSPPT

TCN-536 (5095_N01) heavy chain variable region nucleotide sequence:

```
                                                          (SEQ ID NO: 924)
CAGGTGCAGCTGCAGCAGTGGGGCGCAGGACTGTTGAAGCCTTCGGAGACCCTGTCCCTCACCTGCGCTGTCTAT

GGTGGGTCCTTCAGTGTCAGTGGTTACTACTGGAGCTGGATCCGCCAGCCCCCAGGGAGGGGGCTGGAGTGGATT

GGGGAAATCAGTCATGGTGGAAGCACCAACTACAACCCGTCCCTCAAGAGTCGAGTCACCATATCAGTGGACACG

ACCAAGAACCAGTTCTCCCTGAGACTGAGCTCTGTGACCGCCGCGGACACGGCCGTCTATTACTGTGCGAGAGGG

ACAGACCCTGACACGGAAGTATATTGTCGTGTTGGTAACTGCGCGGCCTTTGACTACTGGGGCCAGGGAAGCCTG

GTCACCGTCTCCTCA
```

TCN-536 (5095_N01) gamma heavy chain variable region amino acid sequence:
(Kabat CDRs in bold, Chothia CDRs underlined)
                                                          (SEQ ID NO: 925)
QVQLQQWGAGLLKPSETLSLTCAVY<u>GGSFSVSGYY</u>WSWIRQPPGRGLEWIGEISHGGSTNYNPSLKS

RVTISVDTTKNQFSLRLSSVTAADTAVYYCAR<u>GTDPDTEVYCRVGNCAAFDY</u>WGQGSLVTVSS

TCN-536 (5095_N01) gamma heavy chain Kabat CDRs:
CDR 1:
                                                          (SEQ ID NO: 926)
VSGYYWS CDR 2:
                                                          (SEQ ID NO: 927)
EISHGGSTNYNPSLKS CDR 3:
                                                          (SEQ ID NO: 928)
GTDPDTEVYCRVGNCAAFDY TCN-536 (5095_N01) gamma heavy chain Chothia CDRs:
CDR 1:
                                                          (SEQ ID NO: 929)
GGSFSVSG CDR 2:
                                                          (SEQ ID NO: 930)
EISHGGSTN CDR 3:
                                                          (SEQ ID NO: 928)
GTDPDTEVYCRVGNCAAFDY TCN-536 (5095_N01) light chain variable region nucleotide sequence:
                                                          (SEQ ID NO: 931)
```
GAAATTATATTGGCGCAGTCTCCAGGCACCCTGTCTTTGTCTCCAGGGGAGAGAGCCACCCTCTCCTGCAGGGCC

AGCCAGTTTGTTAGCACCAGATCCCTGGCCTGGTACCAGCAGAGACCTGGCCAGGCTCCCAGACTCCTCATCTAT

GGTGCATCCAGCAGGGCCACTGGCATCCCAGACAGGTTCAGTGGCAGTGGGTCTGGGACAGACTTCACGCTCACC

ATCAGCAGACTGGAGCCTGAAGATTTTGCAGTGTATTACTGTCAGCACTATGGTTACTCACCTAGGTACGCTTTT

GGCCAGGGGTCCAAGGTTGAGATCAAA
```

TCN-536 (5095_N01) light chain variable region amino acid sequence (Kabat CDRs
in bold, Chothia CDRs underlined)
                                                          (SEQ ID NO: 932)
EIILAQSPGTLSLSPGERATLSC<u>RASQFVSTRSLA</u>WYQQRPGQAPRLLIY<u>GASSRAT</u>GIPDRFSGSGSGT DFTLTISRLEPEDFAVYYC<u>QHYGYSPRYA</u>FGQGSKVEIK TCN-536 (5095_N01) Light chain Kabat CDRs:
CDR 1:
                                                          (SEQ ID NO: 933)
RASQFVSTRSLA CDR 2:
                                                          (SEQ ID NO: 768)
GASSRAT CDR 3:
                                                          (SEQ ID NO: 934)
QHYGYSPRYA TCN-536 (5095_N01) Light chain Chothia CDRs:
CDR 1:

```
                                                                (SEQ ID NO: 933)
RASQFVSTRSLA

CDR 2:
                                                                (SEQ ID NO: 768)
GASSRAT

CDR 3:
                                                                (SEQ ID NO: 934)
QHYGYSPRYA

TCN-537 (3194_D21) heavy chain variable region nucleotide sequence:
                                                                (SEQ ID NO: 935)
CAGGTGCAGCTCCAACAGTGGGGCTCAGGACTGTTGAAGCCTTCGGAGACCCTGTCCCTCACCTGCGCTGTCTAT

GGTGGGTCCTTCAGAGATGACTACTGGACCTGGATTCGCCAGCCCCCAGGCAAGGGGCTGGAGTGGATTGGGGAA

ATCAATCATAGTGGAAGAACCAACTACAACCCGTCCCTCAAGAGTCGAGTCACCATATCAGTAGACACGTCCCTG

AAACAGTTCTCCTTGAAGGTGATTTCTGTGACCGCCGCGGACACGGCTGTTTATTACTGTGCGAGAGGGACGAGC

CATGTTTCCCGGTATTTTGATTGGTTACCACCCACCAACTGGTTCGACCCCTGGGGCCAGGGAACCCAGGTCACC

GTCTCGAGC

TCN-537 (3194_D21) gamma heavy chain variable region amino acid sequence:
(Kabat CDRs in bold, Chothia CDRs underlined)
                                                                (SEQ ID NO: 936)
QVQLQQWGSGLLKPSETLSLTCAVY<u>GGSFR</u>DDYWTWIRQPPGKGLEWIGEINHSGRTNYNPSLKSRV

TISVDTSLKQFSLKVISVTAADTAVYYCARGTSHVSRYFDWLPPTNWFDPWGQGTQVTVSS

TCN-537 (3194_D21) gamma heavy chain Kabat CDRs:
CDR 1:
                                                                (SEQ ID NO: 937)
DDYWT CDR 2:
                                                                (SEQ ID NO: 938)
EINHSGRTNYNPSLKS CDR 3:
                                                                (SEQ ID NO: 939)
GTSHVSRYFDWLPPTNWFDP TCN-537 (3194_D21) gamma heavy chain Chothia CDRs:
CDR 1:
                                                                (SEQ ID NO: 940)
GGSFRD CDR 2:
                                                                (SEQ ID NO: 941)
EINHSGRTN CDR 3:
                                                                (SEQ ID NO: 939)
GTSHVSRYFDWLPPTNWFDP TCN-537 (3194_D21) light chain variable region nucleotide sequence:
                                                                (SEQ ID NO: 942)
GACATTGTGTTGACGCAGTCTCCAGGCACCCTGTCTTTGTCTCCAGGGGAAAGAGCCACCCTCTCCTGCAGGGCC

AGTCAGAGTGTTAGCAGCAGCTACTTAGCCTGGTACCAGCAGAAACCTGGCCAGGCTCCCAGGCTCGTCATGTAT

GGTGCAGCCACCAGGGCCACTGGCATCCCAGACAGGTTCAGTGGCAGTGGGTCTGGGCCAGACTTCACTCTCACC

ATCAGCAGACTGGAGCCTGAAGATTTTGCAATGTATTACTGTCAGCAGTATGGTAACTCACCGATCACCTTCGGC

CAAGGGACACGACTGGAGATCAAA

TCN-537 (3194_D21) light chain variable region amino acid sequence (Kabat CDRs
in bold, Chothia CDRs underlined)
                                                                (SEQ ID NO: 943)
DIVLTQSPGTLSLSPGERATLSC<u>RASQSVSSSYLA</u>WYQQKPGQAPRLVMY<u>GAATRAT</u>GIPDRFSGSGS

GPDFTLTISRLEPEDFAMYYCQQYGNSPITFGQGTRLEIK

TCN-537 (3194_D21) Light chain Kabat CDRs:
CDR 1:
```

```
                                                                    (SEQ ID NO: 944)
RASQSVSSSYLA

CDR 2:
                                                                    (SEQ ID NO: 945)
GAATRAT

CDR 3:
                                                                    (SEQ ID NO: 946)
QQYGNSPIT

TCN-537 (3194_D21) Light chain Chothia CDRs:
CDR 1:
                                                                    (SEQ ID NO: 944)
RASQSVSSSYLA CDR 2:
                                                                    (SEQ ID NO: 945)
GAATRAT CDR 3:
                                                                    (SEQ ID NO: 946)
QQYGNSPIT TCN-538 (3206_O17) heavy chain variable region nucleotide sequence:
                                                                    (SEQ ID NO: 947)
CAGATCACCTTGAAGGAGTCTGGTCCTACACTGGTGAAACCCACACAGACCCTCACACTGACCTGCGTCTTCTCT

GGGTTCTCACTCAGCATTACTGGAGTGCGTGTGGGCTGGATCCGTCAGCCCCCAGGAAAGGCCCTGGAGTGGCTT

GCACTCATTTCTTGGGATGATGAAAAGCACTACAGCCCATCTCTGCAGAGTAGGCTCACCATCACCAAGGACACC

TCCAAAAACCAGGTGGTCCTTACAATGACCAACCTGGACCCTGTCGACACAGCCACATATTACTGTGCACGGTCA

ACCGACAGGGGCCACGTCTTACGATATTTTGGCTGGATGTTACCGGGTGATGCATTTGATGTCTGGGGCCAAGGG

ACAATGGTCACCGTCTCGAGC

TCN-538 (3206_O17) gamma heavy chain variable region amino acid sequence:
(Kabat CDRs in bold, Chothia CDRs underlined)
                                                                    (SEQ ID NO: 948)
QITLKESGPTLVKPTQTLTLTCVFSGFSLS_ITGVRVG_WIRQPPGKALEWLA_LISWDDEKHYSPSLQS_RL

TITKDTSKNQVVLTMTNLDPVDTATYYCAR_**STDRGHVLRYFGWMLPGDAFDV**_WGQGTMVTVSS

TCN-538 (3206_O17) gamma heavy chain Kabat CDRs:
CDR 1:
                                                                    (SEQ ID NO: 949)
ITGVRVG CDR 2:
                                                                    (SEQ ID NO: 950)
LISWDDEKHYSPSLQS CDR 3:
                                                                    (SEQ ID NO: 951)
STDRGHVLRYFGWMLPGDAFDV TCN-538 (3206_O17) gamma heavy chain Chothia CDRs:
CDR 1:
                                                                    (SEQ ID NO: 952)
GFSLSITG CDR 2:
                                                                    (SEQ ID NO: 953)
LISWDDEKH CDR 3:
                                                                    (SEQ ID NO: 951)
STDRGHVLRYFGWMLPGDAFDV TCN-538 (3206_O17) light chain variable region nucleotide sequence:
                                                                    (SEQ ID NO: 954)
GACATCGTGATGACCCAGTCTCCAGACTTCCTGCCTGTGTCTCTGGGCGAGAGGGCCACCATCAACTGCAAGTCC

AGCCAGAGAGTTTTATACAGCTCCAACAATAAAAACTACTTAGCTTGGTACCAGCTGAAACCAGGGCAGCCTCCT

AAGTTGATCATTTATTGGGCATCTACCCGGGAATCCGGGGTCCCTGACCGATTCAGTGGCAGCGGGTCTGGGACA

GAATTCACTCTCACCATCAGCAGCCTGCAGGCTGAAGATGTGGCAGTTTATTACTGTCAACAATATTATAGTCGT
```

```
                                  -continued
CCGTACACTTTTGGCCAGGGGACCAAGCTCGAGATCAAA TCN-538 (3206_O17) light chain variable region amino acid sequence (Kabat CDRs
in bold, Chothia CDRs underlined)
                                                           (SEQ ID NO: 955)
DIVMTQSPDFLPVSLGERATINCKSSQRVLYSSNNKNYLAWYQLKPGQPPKLIIYWASTRESGVPDRFS

GSGSGTEFTLTISSLQAEDVAVYYCQQYYSRPYTFGQGTKLEIK

TCN-538 (3206_O17) Light chain Kabat CDRs:
CDR 1:
                                                           (SEQ ID NO: 956)
KSSQRVLYSSNNKNYLA CDR 2:
                                                           (SEQ ID NO: 957)
WASTRES CDR 3:
                                                           (SEQ ID NO: 958)
QQYYSRPYT TCN-538 (3206_O17) Light chain Chothia CDRs:
CDR 1:
                                                           (SEQ ID NO: 956)
KSSQRVLYSSNNKNYLA CDR 2:
                                                           (SEQ ID NO: 957)
WASTRES CDR 3:
                                                           (SEQ ID NO: 958)
QQYYSRPYT TCN-539 (5056_A08) heavy chain variable region nucleotide sequence:
                                                           (SEQ ID NO: 959)
CAGGTGCAGCTGGTGGAGTCTGGGGGAGGCGTGGTCCAGCCTGGGAGGTCCCTGAGACTCTCCTGTGCAGCCTCT

GAAATCACCTTCATTACCTATGCTATGCACTGGGTCCGCCAGGCCCCAGGCAAGGGGCTGGAGTGGGTGGCACTT

ATATCAGATGATGGAAGCAATAAATTCTACGCAGACTCCGTGAAGGGCCGATTCACCATCTCCAGAGACAATTCC

AAGAACACGCTGTATCTGCAAATGAACAGCCTGAGAGCTGAGGACACGGCTGCTTATTACTGTGCGAGAGAAGGG

GTTTACTTTGATTCGGGGACTTATAGGGGCTACTTTGACTACTGGGGCCAGGAAACCCTGGTCACCGTCTCGAGC

TCN-539 (5056_A08) gamma heavy chain variable region amino acid sequence:
(Kabat CDRs in bold, Chothia CDRs underlined)
                                                           (SEQ ID NO: 960)
QVQLVESGGGVVQPGRSLRLSCAASEITFITYAMHWVRQAPGKGLEWVALISDDGSNKFYADSVKG

RFTISRDNSKNTLYLQMNSLRAEDTAAYYCAREGVYFDSGTYRGYFDYWGQETLVTVSS

TCN-539 (5056_A08) gamma heavy chain Kabat CDRs:
CDR 1:
                                                           (SEQ ID NO: 961)
TYAMH CDR 2:
                                                           (SEQ ID NO: 962)
LISDDGSNKFYADSVKG CDR 3:
                                                           (SEQ ID NO: 963)
EGVYFDSGTYRGYFDY TCN-539 (5056_A08) gamma heavy chain Chothia CDRs:
CDR 1:
                                                           (SEQ ID NO: 964)
EITFIT CDR 2:
                                                           (SEQ ID NO: 965)
LISDDGSNKF CDR 3:
                                                           (SEQ ID NO: 963)
EGVYFDSGTYRGYFDY
```

TCN-539 (5056_A08) light chain variable region nucleotide sequence:
(SEQ ID NO: 966)
GAAATTGTGTTGACACAGTCTCCAGCCACCCTGTCTTTGTCTCCAGGGGAAAGAGCCACCCTCTCCTGCAGGGCC

AGTCAGAGTGTTAGCAGCTACTTAGCCTGGTACCAACAGAAACCTGGCCAGGCTCCCAGGCTCCTCATCTATGAT

GCATCCAACAGGGCCACTGGCATCCCAGCCAGGTTCAGTGGCAGTGGGTCTGGGACAGACTTCACTCTCACCATC

AGCAGCCTAGAGCCTGAAGATTTTGCAGTTTATTACTGTCAGCAGCGTAGCCACTGGCCTCCGATCACCTTCGGC

CAAGGGACACGACTGGAGATCAAA

TCN-539 (5056_A08) light chain variable region amino acid sequence (Kabat CDRs in bold, Chothia CDRs underlined)
(SEQ ID NO: 967)
EIVLTQSPATLSLSPGERATLSCRASQSVSSYLAWYQQKPGQAPRLLIYDASNRATGIPARFSGSGSGTD

FTLTISSLEPEDFAVYYCQQRSHWPPITFGQGTRLEIK

TCN-539 (5056_A08) Light chain Kabat CDRs:
CDR 1:
(SEQ ID NO: 968)
RASQSVSSYLA

CDR 2:
(SEQ ID NO: 969)
DASNRAT

CDR 3:
(SEQ ID NO: 970)
QQRSHWPPIT

TCN-539 (5056_A08) Light chain Chothia CDRs:
CDR 1:
(SEQ ID NO: 968)
RASQSVSSYLA

CDR 2:
(SEQ ID NO: 969)
DASNRAT

CDR 3:
(SEQ ID NO: 970)
QQRSHWPPIT

TCN-540 (5060_F05) heavy chain variable region nucleotide sequence:
(SEQ ID NO: 971)
CAGGTGCAGCTGGTACAATCTGGGGGAGGCGTGGTCCAGCCTGGGAGGTCCCTGAGACTCTCCTGTGCAGCCTCT

GGATTCACCTTCAGTAGCTACGCCATGCACTGGGTCCGCCAGGCTCCAGGCAAGGGGCTGGAGTGGGTGGCTATT

ATATCATACGACGGAAATGATCAATACTATACAGACTCCGTGAAGGGCCGATTCACCATCTCCAGAGACAGCTCC

AAAGTGTATCTCCAAATGCACAGGCTGAGACCTGAGGACACGGCTGTTTATTACTGTGCGAAAGAATTTGAAACT

AGTGGTTATTTTCATGGGAGTTTTGACTACTGGGGCCAGGGAATCCTGGTCACCGTCTCGAGC

TCN-540 (5060_F05) gamma heavy chain variable region amino acid sequence:
(Kabat CDRs in bold, Chothia CDRs underlined)
(SEQ ID NO: 972)
QVQLVQSGGGVVQPGRSLRLSCAAS<u>GFTFS</u>SYAMHWVRQAPGKGLEWVA<u>IISYDGNDQYYTDSVKG</u>

RFTISRDSSKVYLQMHRLPEDTAVYYCAK<u>EFETSGYFHGSFDY</u>WGQGILVTVSS

TCN-540 (5060_F05) gamma heavy chain Kabat CDRs:
CDR 1:
(SEQ ID NO: 973)
SYAMH

CDR 2:
(SEQ ID NO: 974)
IISYDGNDQYYTDSVKG

CDR 3:
(SEQ ID NO: 975)
EFETSGYFHGSFDY

TCN-540 (5060_F05) gamma heavy chain Chothia CDRs:
CDR 1:

-continued

GFTFSS (SEQ ID NO: 976)

CDR 2:

IISYDGNDQY (SEQ ID NO: 977)

CDR 3:

EFETSGYFHGSFDY (SEQ ID NO: 975)

TCN-540 (5060_F05) light chain variable region nucleotide sequence:
(SEQ ID NO: 978)
CAGTCTGCCCTGACTCAGCCTGCCTCCGTGTCTGGGTCTCCTGGACAGTCGATCACCATCTCCTGCACTGGAACC

AGCAGTGACGTTGGTGGTTATAACTATGTCTCCTGGTACCAACAACACCCAGGCAAAGCCCCCAAACTCTTGATT

TATGAGGTCACTAATTGGCCCTCAGGGGTTTCTAATCGCTTCTCTGGCTCCAAGTCTGGCAACACGGCCTCCCTG

ACAATCTCTGGGCTCCAGGCTGAGGACGAGGCTGACTATTACTGCAGCTCATATGCGGGCAGCAGCACTTGGGTG

TTCGGCGGAGGGACCAGGGTGACCGTTCTA

TCN-540 (5060_F05) light chain variable region amino acid sequence (Kabat CDRs
in bold, Chothia CDRs underlined)
(SEQ ID NO: 979)
QSALTQPASVSGSPGQSITISCTGTSSDVGGYNYVSWYQQHPGKAPKLLIYEVTNWPSGVSNRFSGSK

SGNTASLTISGLQAEDEADYYCSSYAGSSTWVFGGGTRVTVL

TCN-540 (5060_F05) Light chain Kabat CDRs:
CDR 1:
(SEQ ID NO: 980)
TGTSSDVGGYNYVS

CDR 2:
(SEQ ID NO: 981)
EVTNWPS

CDR 3:
(SEQ ID NO: 982)
SSYAGSSTWV

TCN-540 (5060_F05) Light chain Chothia CDRs:
CDR 1:
(SEQ ID NO: 980)
TGTSSDVGGYNYVS

CDR 2:
(SEQ ID NO: 981)
EVTNWPS

CDR 3:
(SEQ ID NO: 982)
SSYAGSSTWV

TCN-541 (5062_M11) heavy chain variable region nucleotide sequence:
(SEQ ID NO: 983)
CAGGTGCAGCTGCAGGAGTCGGGCCCAGGACTGGTGAAGCCTTCGGAGACCCTGTCCCTCACCTGCACTGTCTCT

GGTGGCTCCATCAATAGTTACTACTGGAACTGGATCCGGCAGCCCCCAGGGAAGGGACTGGAGTGGATTGGCTAT

ATCTATCACAGTGGGAGCACCAACTACAACCCCTCCCTCAAGAGTCGAGTCACCATTTCGGTAGACACGTCCAAG

AACCAGTTCTCCCTGCAGCTGAGCTCTGTGACCGCCGCAGACACGGCCGTGTATTACTGTGCGAGACTCCGGACG

GACTACGGTGACCCCGACTCGGTATACTACTACGGTATGGACGTCTGGGGCCAAGGGACCACGGTCACCGTCTCG

AGC

TCN-541 (5062_M11) gamma heavy chain variable region amino acid sequence:
(Kabat CDRs in bold, Chothia CDRs underlined)
(SEQ ID NO: 984)
QVQLQESGPGLVKPSETLSLTCTVS<u>GGS</u>INSYYWNWIRQPPGKGLEWIGYIYHSGSTNYPSLKSRVTI

SVDTSKNQFSLQLSSVTAADTAVYYCARLRTDYGDPDSVYYYGMDVWGQGTTVTVSS

TCN-541 (5062_M11) gamma heavy chain Kabat CDRs:
CDR 1:

```
                                                            (SEQ ID NO: 985)
SYYWN

CDR 2:
                                                            (SEQ ID NO: 986)
YIYHSGSTNYNPSLKS

CDR 3:
                                                            (SEQ ID NO: 987)
LRTDYGDPDSVYYYGMDV

TCN-541 (5062_M11) gamma heavy chain Chothia CDRs:
CDR 1:
                                                            (SEQ ID NO: 988)
GGSINS CDR 2:
                                                            (SEQ ID NO: 989)
YIYHSGSTN CDR 3:
                                                            (SEQ ID NO: 987)
LRTDYGDPDSVYYYGMDV TCN-541 (5062_M11) light chain variable region nucleotide sequence:
                                                            (SEQ ID NO: 990)
TCCTATGAGCTGACACAGCCACCCTCGGTGTCAGTGTCCCCAGGACAGACGGCCAGGATCACCTGCTCTGGAGAT

GCATTGCCAAAGCAAAATGCTTATTGGTACCAGCAGAAGCCAGGCCAGGCCCCTGTGCTGCTGATATATAAAGAC

AGTGAGAGGCCCTCAGGGATCCCTGAGCGATTCTCTGGCTCCAGCTCAGGGACAACAGTCACGTTGACCATCAGT

GGAGTCCAGGCAGAGGACGAGGCTGACTATTACTGTCAATCAGCAGACAGCAGTGGTACTTCTTGGGTGTTCGGC

GGAGGGACCAAACTGACCGTTCTA

TCN-541 (5062_M11) light chain variable region amino acid sequence (Kabat CDRs
in bold, Chothia CDRs underlined)
                                                            (SEQ ID NO: 991)
SYELTQPPSVSVSPGQTARITCSGDALPKQNAYWYQQKPGQAPVLLIYKDSERPSGIPERFSGSSSGTT

VTLTISGVQAEDEADYYCQSADSSGTSWVFGGGTKLTVL

TCN-541 (5062_M11) Light chain Kabat CDRs:
CDR 1:
                                                            (SEQ ID NO: 994)
SGDALPKQNAY CDR 2:
                                                            (SEQ ID NO: 995)
KDSERPS CDR 3:
                                                            (SEQ ID NO: 996)
QSADSSGTSWV TCN-541 (5062_M11) Light chain Chothia CDRs:
CDR 1:
                                                            (SEQ ID NO: 994)
SGDALPKQNAY CDR 2:
                                                            (SEQ ID NO: 995)
KDSERPS CDR 3:
                                                            (SEQ ID NO: 996)
QSADSSGTSWV TCN-542 (5079_A16) heavy chain variable region nucleotide sequence:
                                                            (SEQ ID NO: 992)
CAGGTGCAGCTGCAGGAGTCGGGCCCAGGACTGGTGAAGCCTTCACAGACCCTGTCCCTCACCTGCACTGTCTCT

GGTGGCTCCATCAGCAGTGGTAATTACTACTGGAACTGGGTCCGCCAGCACCCAGGGAAGGGCCTGGAGTGGATT

GGGTACATCTATTACAGAGGGAGCACCTTCTACAACCCGTCCCTCAAGAGTCGAGTGACCATATCAATAGACACG

TCTAAGAACCAGTTCTCCCTGAGGCTGAGCTCTGTGACGGCCGCGGACACGGCCGTGTATTACTGTGCGAAGGAT

ACAAGGTCGAGCCTAGACAATTACCAGTACGGTATGGACGTCTGGGGCCAAGGGACCACGGTCACCGTCTCGAGC
```

-continued

TCN-542 (5079_A16) gamma heavy chain variable region amino acid sequence:
(Kabat CDRs in bold, Chothia CDRs underlined)

(SEQ ID NO: 993)
QVQLQESGPGLVKPSQTLSLTCTVS<u>GGSISSGNYYWN</u>WVRQHPGKGLEWIGYIYYRGSTF<u>YNPSLKS</u>R

VTISIDTSKNQFSLRLSSVTAADTAVYYCAK<u>DTRSSLDNYQYGMDV</u>WGQGTTVTVSS

TCN-542 (5079_A16) gamma heavy chain Kabat CDRs:
CDR 1:
(SEQ ID NO: 997)
SGNYYWN

CDR 2:
(SEQ ID NO: 998)
YIYYRGSTFYNPSLKS

CDR 3:
(SEQ ID NO: 999)
DTRSSLDNYQYGMDV

TCN-542 (5079_A16) gamma heavy chain Chothia CDRs:
CDR 1:
(SEQ ID NO: 1000)
GGSISSGN

CDR 2:
(SEQ ID NO: 1001)
YIYYRGSTF

CDR 3:
(SEQ ID NO: 999)
DTRSSLDNYQYGMDV

TCN-542 (5079_A16) light chain variable region nucleotide sequence:
(SEQ ID NO: 1002)
CAGACTGTGGTGACTCAGGAGCCCTCACTGACTGTGTCCCCAGGAGGGACAGTCACTCTCACCTGTGCTTCCAGC

ACTGGAGCAGTCACCAGTAGTTACTTTCCAAACTGGTTCCAGCAGAAACCTGGACAAGCGCCCAGGCCACTGATT

TATAGTACAACTATCAGACACTCCTGGACCCCGGCCCGATTCTCAGGCTCCCTCCTTGGGGGCAAAGCTGCCCTG

ACACTGTCAGGTGTGCAGCCTGAGGACGAGGCTGACTATTACTGCCTGCTCTACTCTGGTGGTGATCCAGTGGCT

TTCGGCGGAGGGACCAAACTGACCGTTCTA

TCN-542 (5079_A16) light chain variable region amino acid sequence (Kabat CDRs
in bold, Chothia CDRs underlined)
(SEQ ID NO: 1003)
QTVVTQEPSLTVSPGGTVTLTC<u>ASSTGAVTSSYFPN</u>WFQQKPGQAPRPLIYSTTIRHSWTPARFSGSLL GGKAALTLSGVQPEDEADYYC<u>LLYSGGDPVA</u>FGGGTKLTVL TCN-542 (5079_A16) Light chain Kabat CDRs:
CDR 1:
(SEQ ID NO: 1004)
ASSTGAVTSSYFPN

CDR 2:
(SEQ ID NO: 1005)
STTIRHS

CDR 3:
(SEQ ID NO: 1006)
LLYSGGDPVA

TCN-542 (5079_A16) Light chain Chothia CDRs:
CDR 1:
(SEQ ID NO: 1004)
ASSTGAVTSSYFPN

CDR 2:
(SEQ ID NO: 1005)
STTIRHS

CDR 3:
(SEQ ID NO: 1006)
LLYSGGDPVA

TCN-543 (5081_G23) heavy chain variable region nucleotide sequence:
(SEQ ID NO: 1007)
CAGGTTCATCTGGTGCAGTCTGGAGCTGAGGTGAGGAAGCCTGGGGACTCAGTGAAGGTCTCCTGTAAGACTTCT

```
GGTTACACCTTTTCCACCTATCCTGTCGCCTGGGTGCGACAGGTCCCCGGACAAGGGCTTGAGTGGATGGGATGG

ATCAGCACTTACAATGGAAACACAAACTTTGCACAGAACTTCCAGGGCAGAGTCACCCTGACCACAGACACAACC

ACGAACACAGCCTACATGGAAGTGAGGAGCCTGAAATTTGACGACACGGCCGTCTATTACTGTGCGAGAGTGGAA

GGCTCGTACAGGGATTTTTGGAATAATCAAAACAGATTCGACCCCTGGGGCCAGGGAACCCTGGTCACCGTCTCG

AGC
```

TCN-543 (5081_G23) gamma heavy chain variable region amino acid sequence:
(Kabat CDRs in bold, Chothia CDRs underlined)
(SEQ ID NO: 1008)
QVHLVQSGAEVRKPGDSVKVSCKTS<u>GYTFST</u>TYPVAWVRQVPGQGLEWMGWISTYNGNTNFAQNFQ
GRVTLTTDTTTNTAYMEVRSLKFDDTAVYYCARVEGSYRDFWNNQNRFDPWGQGTLVTVSS TCN-543 (5081_G23) gamma heavy chain Kabat CDRs:
CDR 1:
(SEQ ID NO: 1009)
TYPVA

CDR 2:
(SEQ ID NO: 1010)
WISTYNGNTNFAQNFQG

CDR 3:
(SEQ ID NO: 1011)
VEGSYRDFWNNQNRFDP

TCN-543 (5081_G23) gamma heavy chain Chothia CDRs:
CDR 1:
(SEQ ID NO: 1012)
GYTFST

CDR 2:
(SEQ ID NO: 1013)
WISTYNGNTN

CDR 3:
(SEQ ID NO: 1011)
VEGSYRDFWNNQNRFDP

TCN-543 (5081_G23) light chain variable region nucleotide sequence:
(SEQ ID NO: 1014)
```
TCCTATGTACTGACTCAGCCACCCTCGGTGTCAGTGGCCCCAGGACAGACGGCCAGGATTTCCTGTGGGGGAAGC

AACATTGGAGGGAAAAGTGTGCACTGGTACCAGCAGAAGCCAGGCCAGGCCCCTGTGCTGGTCGTCTATGATGAT

AGCGGCCGGCCCTCAGGGATCCCTGAGCGATTCTCTGGCTCCAACTCTGGGGACACGGCCACCCTGACCATCAGC

AGGGTCGAAGCCGGGGATGAGGCCGACTATTTCTGTCAGGTGTGGGATAATTTCGGGGGAGTCTTCGGAACTGGG

ACCAAGGTCACCGTTCTA
```

TCN-543 (5081_G23) light chain variable region amino acid sequence (Kabat CDRs
in bold, Chothia CDRs underlined)
(SEQ ID NO: 1015)
SYVLTQPPSVSVAPGQTARISCGGSNIGGKSVHWYQQKPGQAPVLVVYDDSGRPSGIPERFSGSNSGD
TATLTISRVEAGDEADYFCQVWDNFGGVFGTGTKVTVL TCN-543 (5081_G23) Light chain Kabat CDRs:
CDR 1:
(SEQ ID NO: 1016)
GGSNIGGKSVH

CDR 2:
(SEQ ID NO: 1017)
DDSGRPS

CDR 3:
(SEQ ID NO: 1018)
QVWDNFGGV

TCN-543 (5081_G23) Light chain Chothia CDRs:
CDR 1:

-continued

GGSNIGGKSVH (SEQ ID NO: 1016)

CDR 2:

DDSGRPS (SEQ ID NO: 1017)

CDR 3:

QVWDNFGGV (SEQ ID NO: 1018)

TCN-544 (5082_A19) heavy chain variable region nucleotide sequence:
(SEQ ID NO: 1019)
CAGGTGCAGCTGCAGGAGTCGGGCCCAGGGCTGGTGAAGCCTTCGGAGACCCTGTCCCTCACCTGCACTGTCTCT

CGTGGCTCCATCGGTCATTACTTCTGGAGCTGGATCCGGCAGCCCCCAGGGAAGGGACTGGAGTGGATTGGTTAT

ATCTCTTACAGTGGGAGCACCAAGTACAACCCCTCCCTCAGGAGTCGAGTCACCATATCAGTAGACACGTCCAAG

AACCAGTTCTCCCTGAATCTGAACTCTGTCACCGCTACGGACACGGCCCTATATTACTGTGCGAGAGAGGATTAC

GATATTTTGACTGGGGCGGGACCCGGTATGGAGGTCTGGGGCCAAGGGACCACGGTCACCGTCTCGAGC

TCN-544 (5082_A19) gamma heavy chain variable region amino acid sequence:
(Kabat CDRs in bold, Chothia CDRs underlined)
(SEQ ID NO: 1020)
QVQLQESGPGLVKPSETLSLTCTVS<u>RGSIGHYFWS</u>WIRQPPGKGLEWIG<u>YISYSGSTKYNPSLRS</u>RVTIS

VDTSKNQFSLNLNSVTATDTALYYCAREDYDILTGAGPGMEVWGQGTTVTVSS

TCN-544 (5082_A19) gamma heavy chain Kabat CDRs:
CDR 1:

HYFWS (SEQ ID NO: 1021)

CDR 2:

YISYSGSTKYNPSLRS (SEQ ID NO: 1022)

CDR 3:

EDYDILTGAGPGMEV (SEQ ID NO: 1023)

TCN-544 (5082_A19) gamma heavy chain Chothia CDRs:
CDR 1:

RGSIGH (SEQ ID NO: 1024)

CDR 2:

YISYSGSTK (SEQ ID NO: 1025)

CDR 3:

EDYDILTGAGPGMEV (SEQ ID NO: 1023)

TCN-544 (5082_A19) light chain variable region nucleotide sequence:
(SEQ ID NO: 1026)
CAGTCTATGTTGACTCAGCCACCCTCAGCGTCTGGGACCCCCGGGCAGAGGGTCACCATCTCTTGTTCTGGGAGC

AGCTCCAACATCGGAAGTAATACTGTCAACTGGTTCAAACATCTCCCAGGAACGGCCCCCAAACTCCTCATCTAC

AGAAATGATCTGCGGCCCTCAGGGGTCCCTGACCGATTCTCTGGCTCCAAGTCTGGCACCTCAGCCTCCCTGGCC

ATCAGTGGGCTCCAGTCTGAGGATGAGGCTGATTATTACTGTGCAACATGGGATGACAGCCTGAATGGTTTTTAT

GTCTTCGGAACTGGGACCAAAGTCACCGTTCTA

TCN-544 (5082_A19) light chain variable region amino acid sequence (Kabat CDRs
in bold, Chothia CDRs underlined)
(SEQ ID NO: 1027)
QSMLTQPPSASGTPGQRVTISCSGSSSNIGSNTVNWFKHLPGTAPKLLIYRNDLRPSGVPDRFSGSKSGT

SASLAISGLQSEDEADYYCATWDDSLNGFYVFGTGTKVTVL

TCN-544 (5082_A19) Light chain Kabat CDRs:
CDR 1:

SGSSSNIGSNTVN (SEQ ID NO: 1028)

CDR 2:

-continued

RNDLRPS (SEQ ID NO: 1029)

CDR 3:

ATWDDSLNGFYV (SEQ ID NO: 1030)

TCN-544 (5082_A19) Light chain Chothia CDRs:
CDR 1:

SGSSSNIGSNTVN (SEQ ID NO: 1028)

CDR 2:

RNDLRPS (SEQ ID NO: 1029)

CDR 3:

ATWDDSLNGFYV (SEQ ID NO: 1030)

TCN-545 (5082_I15) heavy chain variable region nucleotide sequence:
(SEQ ID NO: 1031)
CAGGTGCAGCTACAGCAGTGGGGCGCAGGACTGTTGAAGCCTTCGGAGACCCTGTCCCTCTCCTGCGCTGTCTTT

GGTGGGTCCTTCAGTGATTACTACTGGACCTGGATACGCCAGCCCCCAGGGAAGGGGCTGGAGTGGATTGGCGAA

ATCAAACATAGTGGAAGAACCAACTACAACCCGTCCCTTGAGAGTCGAGTCACCATATCAGTGGACACGTCCAAG

AACCAGTTTTCCCTGAAACTGAGTTCTGTGACCGCCGCGGACACGGCTATATATTATTGTGCGAGAGGGACAGAC

CCTGACACGGAGGGATATTGTCGTAGTGGTAGCTGCTCGGCCTTTGACTTCTGGGGCCAGGGAACCCTGGTCACC

GTCTCGAGC

TCN-545 (5082_I15) gamma heavy chain variable region amino acid sequence:
(Kabat CDRs in bold, Chothia CDRs underlined)
(SEQ ID NO: 1032)
QVQLQQWGAGLLKPSETLSLSCAVFGGSFSDYYWTWIRQPPGKGLEWIGEIKHSGRTNYNPSLESRV

TISVDTSKNQFSLKLSSVTAADTAIYYCARGTDPDTEGYCRSGSCSAFDFWGQGTLVTVSS

TCN-545 (5082_I15) gamma heavy chain Kabat CDRs:
CDR 1:

DYYWT (SEQ ID NO: 1033)

CDR 2:

EIKHSGRTNYNPSLES (SEQ ID NO: 1034)

CDR 3:

GTDPDTEGYCRSGSCSAFDF (SEQ ID NO: 1035)

TCN-545 (5082_I15) gamma heavy chain Chothia CDRs:
CDR 1:

GGSFSD (SEQ ID NO: 1036)

CDR 2:

EIKHSGRTN (SEQ ID NO: 1037)

CDR 3:

GTDPDTEGYCRSGSCSAFDF (SEQ ID NO: 1035)

TCN-545 (5082_I15) light chain variable region nucleotide sequence:
(SEQ ID NO: 1038)
GAAATTGTGTTGACGCAGTCTCCAGGCACCCTGTCTTTGTCTCCAGGGGAAAGAGCCACCCTCTCCTGCAGGGCC

AGTCACTTTGTGAACTACAGGTCCTTAGCCTGGTACCAGCAGACACCTGGCCAGGTTCCCAGGCTCCTCATCTAT

GGTGCGTCCACCAGGGCCACTGGCATCCCAGACAGGTTCAGTGGCAGTGGGTCTGGGACAGACTTCACTCTCACC

ATCAGCAGACTGGAGCCTGAAGATTTTGCAGTGTATTTCTGTCAGCAGTATGGTGGCTCACCTAGGTACACTTTT

GGCCAGGGGACCAGGCTGGAGATCAAA

TCN-545 (5082_I15) light chain variable region amino acid sequence (Kabat CDRs
in bold, Chothia CDRs underlined)

```
                                                     (SEQ ID NO: 1039)
EIVLTQSPGTLSLSPGERATLSCRASHFVNYRSLAWYQQTPGQVPRLLIYGASTRATGIPDRFSGSGSGT

DFTLTISRLEPEDFAVYFCQQYGGSPRYTFGQGTRLEIK

TCN-545 (5082_I15) Light chain Kabat CDRs:
CDR 1:
                                                     (SEQ ID NO: 1040)
RASHFVNYRSLA CDR 2:
                                                     (SEQ ID NO: 755)
GASTRAT CDR 3:
                                                     (SEQ ID NO: 1041)
QQYGGSPRYT TCN-545 (5082_I15) Light chain Chothia CDRs:
CDR 1:
                                                     (SEQ ID NO: 1040)
RASHFVNYRSLA CDR 2:
                                                     (SEQ ID NO: 755)
GASTRAT CDR 3:
                                                     (SEQ ID NO: 1041)
QQYGGSPRYT TCN-546 (5089_L08) heavy chain variable region nucleotide sequence:
                                                     (SEQ ID NO: 1042)
CAGGTGCAGCTACAGCAGTGGGGCGCAGGACTGTTGAAGCCTTCGGAGACCCTGTCCCTCACCTGCGGTGTCTAT

GGTGGGTCCCTCAGTGATTACTACTGGAGCTGGATCCGCCAGCCCCCAGGGAAGGGGCTGGAGTGGATTGGAGAA

ATCAATCATAGTGGAGGCACCAACTACAATCCGTCCCTCAAGAGACGAGTCACCATATCAGTAGACACGTCAAAG

AAGCAATTCTCCCTGAAGATGAACTCTGTGACCGCCGCGGACACGGCTGTATATTACTGTGCGAGAGGGACAGAC

CCTGACACGGAAGTATATTGTCGTGCTGGTAACTGCGCGGCCTTTGACTTCTGGGGCCAGGGAACCCTGGTCACC

GTCTCGAGC

TCN-546 (5089_L08) gamma heavy chain variable region amino acid sequence:
(Kabat CDRs in bold, Chothia CDRs underlined)
                                                     (SEQ ID NO: 1043)
QVQLQQWGAGLLKPSETLSLTCGVYGGSLSDYYWSWIRQPPGKGLEWIGEINHSGGTNYNPSLKRRV

TISVDTSKKQFSLKMNSVTAADTAVYYCARGTDPDTEVYCRAGNCAAFDFWGQGTLVTVSS

TCN-546 (5089_L08) gamma heavy chain Kabat CDRs:
CDR 1:
                                                     (SEQ ID NO: 1044)
DYYWS CDR 2:
                                                     (SEQ ID NO: 1045)
EINHSGGTNYNPSLKR CDR 3:
                                                     (SEQ ID NO: 1046)
GTDPDTEVYCRAGNCAAFDF TCN-546 (5089_L08) gamma heavy chain Chothia CDRs:
CDR 1:
                                                     (SEQ ID NO: 1047)
GGSLSD CDR 2:
                                                     (SEQ ID NO: 1048)
EINHSGGTN CDR 3:
                                                     (SEQ ID NO: 1046)
GTDPDTEVYCRAGNCAAFDF TCN-546 (5089_L08) light chain variable region nucleotide sequence:
```

-continued

```
                                                    (SEQ ID NO: 1049)
GAAATTGTGTTGACGCAGTCTCCAGGCACCCTGTCTTTGTCTCCAGGGGAGAGAGCCACCCTCTCCTGCCGGGCC

AGTCACTTTGTTATAGGCAGGGCTGTAGCCTGGTACCAGCAGAAACCTGGCCAGGCTCCCAGGCTCCTCATCTAC

GGTGCATCCAGCAGGGCCACTGGCATCCCGGACAGGTTCAGTGGCAGTGGGTCTGGGACAGACTTCACTCTCACC

ATCAGCAGACTGGAGACTGAAGATTTTGCTGTGTTTTACTGTCAGCACTATGGTAGCTCACCTAGGTACGCTTTT

GGCCAGGGGACCAAGCTGGAGATCAAA
```

TCN-546 (5089_L08) light chain variable region amino acid sequence (Kabat CDRs
in bold, Chothia CDRs underlined)

```
                                                    (SEQ ID NO: 1050)
EIVLTQSPGTLSLSPGERATLSCRASHFVIGRAVAWYQQKPGQAPRLLIYGASSRATGIPDRFSGSGSGT

DFTLTISRLETEDFAVFYCQHYGSSPRYAFGQGTKLEIK
```

TCN-546 (5089_L08) Light chain Kabat CDRs:
CDR 1:
```
                                                    (SEQ ID NO: 1051)
RASHFVIGRAVA
```

CDR 2:
```
                                                    (SEQ ID NO: 768)
GASSRAT
```

CDR 3:
```
                                                    (SEQ ID NO: 1052)
QHYGSSPRYAF
```

TCN-546 (5089_L08) Light chain Chothia CDRs:
CDR 1:
```
                                                    (SEQ ID NO: 1051)
RASHFVIGRAVA
```

CDR 2:
```
                                                    (SEQ ID NO: 768)
GASSRAT
```

CDR 3:
```
                                                    (SEQ ID NO: 1052)
QHYGSSPRYAF
```

TCN-547 (5092_F11) heavy chain variable region nucleotide sequence:
```
                                                    (SEQ ID NO: 1053)
CAGGTGCAGCTGCAGGAGTCGGGCCCAGGACTGGTGAAGCCTTCACAGACCCTGTCCCTCACCTGCACTGTCTCT

GGTGACTCCATTAGTAGTGTTGATCACTACTGGAGCTGGATCCGCCAACACCCAGTGAAGGGCCTGGAGTGGATT

GGGTTCATGTATTACAGTGCGAGCACCTATTACAACCCGTCCCTCAAGAGTCGAGTTACCATATCAACGGACACG

TCTAAGAACCAGTTCTCCCTGAGGCTGAGTTCTGTGACTGCCGCGGACACGGCCGTATATTACTGTGCGAGAGGC

ACTTGTGCTGGTGACTGCTCCCTTCACTACTACTACTACGGTTTGGACGTCTGGGGCCAAGGGAGGACGGTCACC

GTCTCGAGC
```

TCN-547 (5092_F11) gamma heavy chain variable region amino acid sequence:
(Kabat CDRs in bold, Chothia CDRs underlined)
```
                                                    (SEQ ID NO: 1054)
QVQLQESGPGLVKPSQTLSLTCTVSGDSISSVDHYWSWIRQHPVKGLEWIGFMYYSASTYYNPSLKSR

VTISTDTSKNQFSLRLSSVTAADTAVYYCARGTCAGDCSLHYYYYGLDVWGQGRTVTVSS
```

TCN-547 (5092_F11) gamma heavy chain Kabat CDRs:
CDR 1:
```
                                                    (SEQ ID NO: 1055)
SVDHYWS
```

CDR 2:
```
                                                    (SEQ ID NO: 1056)
FMYYSASTYYNPSLKS
```

CDR 3:
```
                                                    (SEQ ID NO: 1057)
GTCAGDCSLHYYYYGLDV
```

TCN-547 (5092_F11) gamma heavy chain Chothia CDRs:
CDR 1:

-continued

GDSISSVD (SEQ ID NO: 1058)

CDR 2:

FMYYSASTY (SEQ ID NO: 1059)

CDR 3:

GTCAGDCSLHYYYYGLDV (SEQ ID NO: 1057)

TCN-547 (5092_F11) light chain variable region nucleotide sequence:
(SEQ ID NO: 1060)
GACATCCAGATGACCCAGTCTCCATCCTCCCTGTCTGCATCTGTAGGAGACAGAGTCACCATCACTTGCCGGGCA

AGTCAGAGCATTAGCAGCTATTTAAATTGGTATCAGCACAAACCAGGGAAAGCCCCTAAGGTCCTGATGTATGCT

GTATCCATTTTGCAAAGTGGGGTCCCATCAAGGTTCAGTGGCAGTGGATCTGGGCAGATTTCACTCTCACCATC

AGCAGTCTGCAACCTGAAGATTTTGCAACTTACTACTGTCAACAGAGTTACAGTTCCCCGCTCACTTTCGGCGGA

GGGACCAAGGTGGAGATCAAA

TCN-547 (5092_F11) light chain variable region amino acid sequence (Kabat CDRs
in bold, Chothia CDRs underlined)
(SEQ ID NO: 1061)
DIQMTQSPSSLSASVGDRVTITCRASQSISSYLNWYQHKPGKAPKVLMYAVSILQSGVPSRFSGSGSGA

DFTLTISSLQPEDFATYYCQQSYSSPLTFGGGTKVEIK

TCN-547 (5092_F11) Light chain Kabat CDRs:
CDR 1:
(SEQ ID NO: 1062)
RASQSISSYLN

CDR 2:
(SEQ ID NO: 1063)
AVSILQS

CDR 3:
(SEQ ID NO: 1064)
QQSYSSPLT

TCN-547 (5092_F11) Light chain Chothia CDRs:
CDR 1:
(SEQ ID NO: 1062)
RASQSISSYLN

CDR 2:
(SEQ ID NO: 1063)
AVSILQS

CDR 3:
(SEQ ID NO: 1064)
QQSYSSPLT

TCN-548 (5092_P01) heavy chain variable region nucleotide sequence:
(SEQ ID NO: 1065)
CAGGTGCAGCTGCAGGAGTCGGGCCCAGGACTGGTGAAGCCTTCGGAGACCCTGTCCCTCACCTGCACTGTCTCT

AGTGGCCCCATGAGTGATTATTACTGGAGCTGGATCCGGCAGCCCCCAGGGAAGGGACTGGAGTGGATTGGGCAT

GTCTCTGTCTCTCACGGAGGGAGGACCAAATCCAATCCCTCCGTCATGAGTCGAGTCACCATTTCAGTAGAAACG

TCCAAGAACCAATTCTCCCTGAAACTGACCTCCGTGACCGCTGCGGACACGGCCGTTTATTACTGTGCGAGATTA

AATTACTATGATAGAAGTGGTTATCATTCGCCTGACGGCCCCTCGAACAACTGGTTCGACCCCTGGGGCCAGGGA

ACCCTGGTCACCGTCTCGAGC

TCN-548 (5092_P01) gamma heavy chain variable region amino acid sequence:
(Kabat CDRs in bold, Chothia CDRs underlined)
(SEQ ID NO: 1066)
QVQLQESGPGLVKPSETLSLTCTVS<u>SGPMS</u>DYYWSWIRQPPGKGLEWIGHVSVSHGGRTKSNPSVMS

RVTISVETSKNQFSLKLTSVTAADTAVYYCARLNYYDRSGYHSPDGPSNNWFDPWGQGTLVTVSS

TCN-548 (5092_P01) gamma heavy chain Kabat CDRs:
CDR 1:

-continued

DYYWS (SEQ ID NO: 1044)

CDR 2:

HVSVSHGGRTKSNPSVMS (SEQ ID NO: 1067)

CDR 3:

LNYYDRSGYHSPDGPSNNWFDP (SEQ ID NO: 1068)

TCN-548 (5092_P01) gamma heavy chain Chothia CDRs:
CDR 1:

SGPMSD (SEQ ID NO: 1069)

CDR 2:

HVSVSHGGRTK (SEQ ID NO: 1070)

CDR 3:

LNYYDRSGYHSPDGPSNNWFDP (SEQ ID NO: 1068)

TCN-548 (5092_P01) light chain variable region nucleotide sequence:
(SEQ ID NO: 1071)
GACATCGTGATGACCCAGTCTCCAGACTCCCTGGCTGTGTCTCTGGGCGAGAGGGCCACCATCAACTGCAAGTCC

AGCCAGAGTGTTTTATACAGCTCCAACAATAAGAACTACTTAGCTTGGTACCAGCAGAAACCAGGACAGCCTCCT

AAGCTGCTCATTTACTGGGCATCTACCCGGGAATCCGGGGTCCCTGACCGAATCAGCGGCAGCGGGTCTGGGGCA

GATTTCACTCTCACCATCAGCAGCCTGCAGGCTGAAGATGTGGCAGTTTATTACTGTCAGCAGTATTTTGCTACT

CCTCGGACGTTCGGCCAAGGGACCAAGGTGGAAATCAAA

TCN-548 (5092_P01) light chain variable region amino acid sequence (Kabat CDRs
in bold, Chothia CDRs underlined)
(SEQ ID NO: 1072)
DIVMTQSPDSLAVSLGERATINCKSSQSVLYSSNNKNYLAWYQQKPGQPPKLLIYWASTRESGVPDRI

SGSGSGADFTLTISSLQAEDVAVYYCQQYFATPRTFGQGTKVEIK

TCN-548 (5092_P01) Light chain Kabat CDRs:
CDR 1:

KSSQSVLYSSNNKNYLA (SEQ ID NO: 1073)

CDR 2:

WASTRES (SEQ ID NO: 957)

CDR 3:

QQYFATPRT (SEQ ID NO: 1074)

TCN-548 (5092_P01) Light chain Chothia CDRs:
CDR 1:

KSSQSVLYSSNNKNYLA (SEQ ID NO: 1073)

CDR 2:

WASTRES (SEQ ID NO: 957)

CDR 3:

QQYFATPRT (SEQ ID NO: 1074)

TCN-549 (5092_P04) heavy chain variable region nucleotide sequence:
(SEQ ID NO: 1075)
CAGGTACAGCTGGTGCAGTCTGGGGCTGAGGTGAAGAAGCCTGGGGCCTCAGTGAAGGTCTCCTGCAAGGCTTCT

GGATACACCTTCACCGGCTACTATATGCACTGGGTGCGACAGGCCCCTGGACAAGGGCTTGAGTGGATGGGATGG

ATCAACCCTAACAGTGGTGACACAAACTATGCACAGAAGTTTCAGGGCAGGGTCACCATGACCAGGGACACGTCC

ATCACCACAGCCTACATGGAGCTGAGCAGCCTGAGATCTGACGACACGGCCGTGTATTACTGTGCGAGAGATTCC

CCCTATAGCAGCAGCTGGTCCTTCTTTGACTACTGGGGCCAGGGAACCCCTGGTCACCGTCTCGAGC

-continued

TCN-549 (5092_P04) gamma heavy chain variable region amino acid sequence:
(Kabat CDRs in bold, Chothia CDRs underlined)

(SEQ ID NO: 1076)
QVQLVQSGAEVKKPGASVKVSCKAS<u>GYTFTGYYMH</u>WVRQAPGQGLEWMG<u>WINPNSGDTNYAQKF</u>

<u>QG</u>RVTMTRDTSVITAYMELSSLRSDDTAVYYCAR<u>DSPYSSSWSFFDY</u>CWGQGPLVTVSS

TCN-549 (5092_P04) gamma heavy chain Kabat CDRs:
CDR 1:
(SEQ ID NO: 1077)
GYYMH

CDR 2:
(SEQ ID NO: 1078)
WINPNSGDTNYAQKFQG

CDR 3:
(SEQ ID NO: 1079)
DSPYSSSWSFFDY

TCN-549 (5092_P04) gamma heavy chain Chothia CDRs:
CDR 1:
(SEQ ID NO: 1080)
GYTFTG

CDR 2:
(SEQ ID NO: 1081)
WINPNSGDTN

CDR 3:
(SEQ ID NO: 1079)
DSPYSSSWSFFDY

TCN-549 (5092_P04) light chain variable region nucleotide sequence:
(SEQ ID NO: 1082)
GACATCGTGATGACCCAGTCTCCAGACTCCCTGGCTGTGTCTCTGGGCGAGAGGGCCACCATCAACTGCAAGTCC

AGCCAGAGTGTTTTATACAGCTCCAACAATAAGAGCCACTTAGCTTGGTACCAGCAGAAACCAGGACAGCCTCCT

AAGTTGCTCATTTACTGGGCATCTACCCGGGAATCCGGGGTCCCTGACCGATTCAGTGGCAGCGGGTCTGGGACA

GATTTCACCCTCATCATCAGCAGCCTGCAGGCTGAGGATGTGGCAGTTTATTACTGTCAGCAATATTATTTTTCT

CCCCTCACTTTCGGCGGAGGGACCAAGGTGGAGATCAAA

TCN-549 (5092_P04) light chain variable region amino acid sequence (Kabat CDRs
in bold, Chothia CDRs underlined)
(SEQ ID NO: 1083)
DIVMTQSPDSLAVSLGERATINC<u>KSSQSVLYSSNNKSHLA</u>WYQQKPGQPPKLLIY<u>WASTRES</u>GVPDRF

SGSGSGTDFTLIISSLQAEDVAVYYCQQYYFSPLTFGGGTKVEIK

TCN-549 (5092_P04) Light chain Kabat CDRs:
CDR 1:
(SEQ ID NO: 1084)
KSSQSVLYSSNNKSHLA

CDR 2:
(SEQ ID NO: 957)
WASTRES

CDR 3:
(SEQ ID NO: 1085)
QQYYFSPLT

TCN-549 (5092_P04) Light chain Chothia CDRs:
CDR 1:
(SEQ ID NO: 1084)
KSSQSVLYSSNNKSHLA

CDR 2:
(SEQ ID NO: 957)
WASTRES

CDR 3:
(SEQ ID NO: 1085)
QQYYFSPLT

TCN-550 (5096_F06) heavy chain variable region nucleotide sequence:

-continued

TCN-550 (5096_F06) gamma heavy chain variable region nucleotide sequence (continued):
(SEQ ID NO: 1086)
```
CAGGTGCAGCTGCAGGAGTCGGGCCCAGGACTGGTGAAGCCTTCGGAGACCCTGTCCCTCACCTGCACTGTCTCT
GGTGCCTCCATCAATAGTCACTACTGGAGCTGGATCCGGCAGCCCCCAGGGAAGGGACTGGAGTGGATTGGGTAT
GTCTATTACAGTGGGAGCACCACCTACAACCCCTCCCTCAAGAGTCGAGTCACCTTATCAGTAGATACGTCCAAG
AACCAGTTCTCCCTGAACCTGAGCTCTGTGACCGCCGCAGACACGGCCTTCTATTACTGTGCGAGACATCCCTAC
GATGTTTTGACTGGTTCCGGGGACTGGTTCGACCCCTGGGGCCAGGGAACCCTGGTCACCGTCTCGAGC
```

TCN-550 (5096_F06) gamma heavy chain variable region amino acid sequence:
(Kabat CDRs in bold, Chothia CDRs underlined)
(SEQ ID NO: 1087)
QVQLQESGPGLVKPSETLSLTCTVS<u>GASINSHYWS</u>WIRQPPGKGLEWIG<u>YVYYSGSTT</u>YNPSLKSRVT
LSVDTSKNQFSLNLSSVTAADTAFYYCARHPYDVLTGSGDWFDPWGQGTLVTVSS TCN-550 (5096_F06) gamma heavy chain Kabat CDRs:
CDR 1:
(SEQ ID NO: 1088)
SHYWS

CDR 2:
(SEQ ID NO: 1089)
YVYYSGSTTYNPSLKS

CDR 3:
(SEQ ID NO: 1090)
HPYDVLTGSGDWFDP

TCN-550 (5096_F06) gamma heavy chain Chothia CDRs:
CDR 1:
(SEQ ID NO: 1091)
GASINSH

CDR 2:
(SEQ ID NO: 1092)
YVYYSGSTT

CDR 3:
(SEQ ID NO: 1090)
HPYDVLTGSGDWFDP

TCN-550 (5096_F06) light chain variable region nucleotide sequence:
(SEQ ID NO: 1093)
```
TCCTATGTTCTGACTCAGGCACCCTCGGTGTCAGTGGCCCCAGGACAGACGGCCAGGATTACCTGTGGGGGAAAT
GCCATTGGAAGTAAAAAAGTTCACTGGTACCAGCACAAGGCAGGCCAGGCCCCTGTACTCGTCGTCTATGATGAT
ACAGACCGGCCCTCAGGGATCCCTGAGCGATTCTCTGGCTCCAACTCTTGGAGCACGGCCACCCTGACCATCAAC
AGGGTCGAAGCCGGGGATGAGGCCGACTATTACTGTCAGGTGTGGGATTTTACCATTGATCATGTGGTCTTCGGC
GGAGGGACCAAGCTGACCGTTCTA
```

TCN-550 (5096_F06) light chain variable region amino acid sequence (Kabat CDRs
in bold, Chothia CDRs underlined)
(SEQ ID NO: 1094)
SYVLTQAPSVSVAPGQTARITC<u>GGNAIGSKKVH</u>WYQHKAGQAPVLVVYDDTDRPSGIPERFSGSNSW
STATLTINRVEAGDEADYYCQVWDFTIDHVVFGGGTKLTVL TCN-550 (5096_F06) Light chain Kabat CDRs:
CDR 1:
(SEQ ID NO: 1095)
GGNAIGSKKVH

CDR 2:
(SEQ ID NO: 1096)
DDTDRPS

CDR 3:
(SEQ ID NO: 1097)
QVWDFTIDHVV

TCN-550 (5096_F06) Light chain Chothia CDRs:
CDR 1:

-continued

GGNAIGSKKVH (SEQ ID NO: 1095)

CDR 2:
DDTDRPS (SEQ ID NO: 1096)

CDR 3:
QVWDFTIDHVV (SEQ ID NO: 1097)

TCN-551 (5243_D01) heavy chain variable region nucleotide sequence:
(SEQ ID NO: 1098)
GAGGTGCAACTGGTTCAGTCTGGATCAGAGGTGAAAAAGCCCGGGGAGTCTCTGAAGATCTCCTGTAAGGGTTCT

GGCTACAGCTTTAGCAACTACTGGATCGGCTGGGTGCGCCACATGCCCGGGAAAGGCCTGGAATGGATGGGGATC

ATTTATCCTGGTGACTCTGATACCAGATACAGCCCGTCCTTCCAAGGCCAGGTCACCATGTCAGCCGACAAGTCC

AGCAGCACCGTCTACCTGCAGTGGAGCAGCCTGAAGGCCTCGGACACCGCCATTTATTATTGTGCGAGACGGGGC

GGACATAGTTTTGGATATGGGTCGGGGGGGGACACGCACAGTGAATTCGACTCCTGGGGCCAGGGAACCCTGGTC

ACCGTCTCGAGC

TCN-551 (5243_D01) gamma heavy chain variable region amino acid sequence:
(Kabat CDRs in bold, Chothia CDRs underlined)
(SEQ ID NO: 1099)
EVQLVQSGSEVKKPGESLKISCKGS<u>GYSFS</u>NYWIGWVRHMPGKGLEWMG<u>IIYPGDSDTR</u>YSPSFQGQ VTMSADKSSSTVYLQWSSLKASDTAIYYCAR<u>RGGHSFGYGSGGDTHSEFDS</u>WGQGTLVTVSS TCN-551 (5243_D01) gamma heavy chain Kabat CDRs:
CDR 1:
NYWIG (SEQ ID NO: 1100)

CDR 2:
IIYPGDSDTRYSPSFQG (SEQ ID NO: 1101)

CDR 3:
RGGHSFGYGSGGDTHSEFDS (SEQ ID NO: 1102)

TCN-551 (5243_D01) gamma heavy chain Chothia CDRs:
CDR 1:
GYSFSN (SEQ ID NO: 1103)

CDR 2:
IIYPGDSDTR (SEQ ID NO: 1104)

CDR 3:
RGGHSFGYGSGGDTHSEFDS (SEQ ID NO: 1102)

TCN-551 (5243_D01) light chain variable region nucleotide sequence:
(SEQ ID NO: 1105)
CAGTCTGTATTGACGCAGTCGCCCTCAGTGTCTGCGGCCCCAGGACAGAAGGTCACCATCTCCTGCTCTGGAAGC

GACTCCAACATTGGTGATTATTTTGTATGTTGGTACCAGCACCTCCCAGGAAAACCCCCCCAACTCCTCATCTAT

GAAAATAATAAGCGACCCTCAGGGATTCCTGACCGATTCTCTGGCTCCAAGTCTGGCACGTCAGCCACCCTGGGC

ATCACCGGAATCCAGACCGGGGACGAGGCCGATTACTACTGCGCAACTTGGGATGGCAGCCTGAGTGCTTGGGTG

TTCGGCGGAGGGACCAAGCTGACCGTTCTA

TCN-551 (5243_D01) light chain variable region amino acid sequence (Kabat CDRs
in bold, Chothia CDRs underlined)
(SEQ ID NO: 1106)
QSVLTQSPSVSAAPGQKVTISC<u>SGSDSNIGDYFVC</u>WYQHLPGKPPQLLIYENNKRPSGIPDRFSGSKSGT

SATLGITGIQTGDEADYYCATWDGSLSAWVFGGGTKLTVL

TCN-551 (5243_D01) Light chain Kabat CDRs:
CDR 1:

-continued

SGSDSNIGDYFVC
(SEQ ID NO: 1107)

CDR 2:
(SEQ ID NO: 1108)
ENNKRPS

CDR 3:
(SEQ ID NO: 1109)
ATWDGSLSAWV

TCN-551 (5243_D01) Light chain Chothia CDRs:
CDR 1:
(SEQ ID NO: 1107)
SGSDSNIGDYFVC

CDR 2:
(SEQ ID NO: 1108)
ENNKRPS

CDR 3:
(SEQ ID NO: 1109)
ATWDGSLSAWV

TCN-552 (5249_I23) heavy chain variable region nucleotide sequence:
(SEQ ID NO: 1110)
CAGGTCCAAGTGGTGCAGTCTGGGGCTGAGGTGAAGAAGCCTGGGTCCTCGGTGAGGGTCTCCTGCCAGGCTTCT

GGAGGCACCTTCATGAATTATGCTATCATTTGGGTGCGACGGGCCCCTGGACAAGGCCTTGAGTGGATGGGAGGG

ATCATCCCTGTCTTTCCTACACCAAACTACGCACAGATGTTCCAGGGCAGAGTCACGATTTCCACGGACGAATCC

AGGAGCACATCCTTCTTGGAACTGACCAACCTGAGATATGAGGACACGGCCGTTTATTACTGTGCGAGGCGAATT

TATCACGGTGGTAACTCCGGCTTTGACTTCTGGGGCCAGGGAACCCTGGTCACCGTCTCGAGC

TCN-552 (5249_I23) gamma heavy chain variable region amino acid sequence:
(Kabat CDRs in bold, Chothia CDRs underlined)
(SEQ ID NO: 1111)
QVQVVQSGAEVKKPGSSVRVSCQASGGTFMNYAIIWVRRAPGQGLEWMGGIIPVFPTPNYAQMFQG

RVTISTDESRSTSFLELTNLRYEDTAVYYCARRIYHGGNSGFDFWGQGTLVTVSS

TCN-552 (5249_I23) gamma heavy chain Kabat CDRs:
CDR 1:
(SEQ ID NO: 1112)
NYAII

CDR 2:
(SEQ ID NO: 1113)
GIIPVFPTPNYAQMFQG

CDR 3:
(SEQ ID NO: 1114)
RIYHGGNSGFDF

TCN-552 (5249_I23) gamma heavy chain Chothia CDRs:
CDR 1:
(SEQ ID NO: 1115)
GGTFMN

CDR 2:
(SEQ ID NO: 1116)
GIIPVFPTPN

CDR 3:
(SEQ ID NO: 1114)
RIYHGGNSGFDF

TCN-552 (5249_I23) light chain variable region nucleotide sequence:
(SEQ ID NO: 1117)
GAAATTGTGTTGACACAGTCTCCAGCCACCCTGTCTTTGTCTCCAGGGGAAAGAGCCACCCTCTCCTGCAGGGCC

AGTCAGAGTGTTGGCAACTACTTAGCCTGGTACCAACAGAAACCTGGCCAGGCTCCCAGGCTCCTCATCTATGAT

TCATCCAACAGGGCCCCTGGCATCCCAGCCAGGTTCAGTGGCAGTGGGTCTGGGACAGACTTCACTCTCACCATC

AGCAGCCTCGCGCCTGAAGATTTTGCAGTTTATTACTGTCAGCAGCGTAGCAAGTGGCCTCCCATGTACAGTTTT

GGCCATGGGACCAAGCTGGAGATCAAA

-continued

TCN-552 (5249_I23) light chain variable region amino acid sequence (Kabat CDRs in bold, Chothia CDRs underlined)

(SEQ ID NO: 1118)
EIVLTQSPATLSLSPGERATLSCRASQSVGNYLAWYQQKPGQAPRLLIYDSSNRAPGIPARFSGSGSGT

DFTLTISSLAPEDFAVYYCQQRSKWPPMYSFGHGTKLEIK

TCN-552 (5249_I23) Light chain Kabat CDRs:
CDR 1:
(SEQ ID NO: 1119)
RASQSVGNYLA

CDR 2:
(SEQ ID NO: 1120)
DSSNRAP

CDR 3:
(SEQ ID NO: 1121)
QQRSKWPPMYS

TCN-552 (5249_I23) Light chain Chothia CDRs:
CDR 1:
(SEQ ID NO: 1119)
RASQSVGNYLA

CDR 2:
(SEQ ID NO: 1120)
DSSNRAP

CDR 3:
(SEQ ID NO: 1121)
QQRSKWPPMYS

TCN-553 (5261_C18) heavy chain variable region nucleotide sequence:
(SEQ ID NO: 1122)
CAGGTCCAGGTGGTGCAGTCTGGGACTGAGGTGAAGAAGCCTGGGTCCTCGGTGAAGGTCTCCTGCCAGACTTCT

GGAGGCAGGTTCATGAGTTATGCTATCACCTGGGTGCGACAGGCCCCTGGACAAGGGCTTGAGTGGATGGGAGGC

ATCGTCCCTGTCTTCGGAACAGCAAACTACGCTCAGAAGTTCCAGGGCAGAGTCACGATCACCACGGACGATTCC

ACGCGCACAGCCTATATGGAGTTGAGCAGCCTGAGAAGTGAGGACACGGCCGTTTATTACTGTGGGTTCCGATAC

GGCTCTGGTTACGGGTTTGACTCCTGGGGCCAGGGAACCCTGGTCACCGTCTCGAGC

TCN-553 (5261_C18) gamma heavy chain variable region amino acid sequence:
(Kabat CDRs in bold, Chothia CDRs underlined)
(SEQ ID NO: 1123)
QVQVVQSGTEVKKPGSSVKVSCQTSGGRFMSYAITWVRQAPGQGLEWMGGIVPVFGTANYAQKFQ

GRVTITTDDSTRTAYMELSSLRSEDTAVYYCGFRYGSGYGFDSWGQGTLVTVSS

TCN-553 (5261_C18) gamma heavy chain Kabat CDRs:
CDR 1:
(SEQ ID NO: 1124)
SYAIT

CDR 2:
(SEQ ID NO: 1125)
GIVPVFGTANYAQKFQG

CDR 3:
(SEQ ID NO: 1126)
RYGSGYGFDS

TCN-553 (5261_C18) gamma heavy chain Chothia CDRs:
CDR 1:
(SEQ ID NO: 1127)
GGRFMS

CDR 2:
(SEQ ID NO: 1128)
GIVPVFGTAN

CDR 3:
(SEQ ID NO: 1126)
RYGSGYGFDS

TCN-553 (5261_C18) light chain variable region nucleotide sequence:

```
                                                           (SEQ ID NO: 1129)
GAAATTGTATTGACGCAGTCTCCAGGCACCCTGTCTTTGTCTCCAGGGGAAAGAGCCACCCTCTCCTGCAGGGCC

AGTCAGAGTGTTAGTAGCAGCTACTTAGCCTGGTATCAGAAGAAACCTGGCCAGGCTCCCAGGCTCCTCATCTAT

GGTGCTTCCACTAGGGCCACTGGCATCCCGGACCGGTTCACTGGCAGTGGGTCTGGGACAGACTTCACTCTCAGC

ATCAGTAGACTGGAGCCTGAAGATTTTGCAGTGTATTACTGTCAGCACTTTGGTACCTCAGTCTTCACTTTCGGC

GGAGGGACCAAGGTTGAGATCAAA
```

TCN-553 (5261_C18) light chain variable region amino acid sequence (Kabat CDRs
in bold, Chothia CDRs underlined)
```
                                                           (SEQ ID NO: 1130)
EIVLTQSPGTLSLSPGERATLSCRASQSVSSSYLAWYQKKPGQAPRLLIYGASTRATGIPDRFTGSGSGT

DFTLSISRLEPEDFAVYYCQHFGTSVFTFGGGTKVEIK
```

TCN-553 (5261_C18) Light chain Kabat CDRs:
CDR 1:
```
                                                           (SEQ ID NO: 944)
RASQSVSSSYLA
```

CDR 2:
```
                                                           (SEQ ID NO: 755)
GASTRAT
```

CDR 3:
```
                                                           (SEQ ID NO: 1131)
QHFGTSVFT
```

TCN-553 (5261_C18) Light chain Chothia CDRs:
CDR 1:
```
                                                           (SEQ ID NO: 944)
RASQSVSSSYLA
```

CDR 2:
```
                                                           (SEQ ID NO: 755)
GASTRAT
```

CDR 3:
```
                                                           (SEQ ID NO: 1131)
QHFGTSVFT
```

TCN-554 (5277_M05) heavy chain variable region nucleotide sequence:
```
                                                           (SEQ ID NO: 1132)
CAGGTGCAGCTGGTGCAGTCTGGGGCTGATCTGAAGAAGCCTGGGGCCTCAGTGAAGGTCTCCTGCAAGGCTTCT

GGATACACCTTCACCGACTACTATATTCACTGGGTGCGACAGGCCCCTGGACAAGGGCTTGAGTGGATGGGATGG

ATCAACCCTGAAAGTGGTGACACAAAGTATGCACAGAAGTTTCAGGGCAGGGTCACCATGACCAGGGACACGTCC

ATCACCACAGCCTACATGGAGCTGGGTAGGCTGAGATCCGACGACACGGCCGTGTATTACTGTGCGAGAGATGTA

AGTACGACCTGGAGCTGGTTCGCCCCCTGGGGCCAGGGAACCCTGGTCACCGTCTCGAGC
```

TCN-554 (5277_M05) gamma heavy chain variable region amino acid sequence:
(Kabat CDRs in bold, Chothia CDRs underlined)
```
                                                           (SEQ ID NO: 1133)
QVQLVQSGADLKKPGASVKVSCKASGYTFTDYYIHWVRQAPGQGLEWMGWINPESGDTKYAQKFQ

GRVTMTRDTSITTAYMELGRLRSDDTAVYYCARDVSTTWSWFAPWGQGTLVTVSS
```

TCN-554 (5277_M05) gamma heavy chain Kabat CDRs:
CDR 1:
```
                                                           (SEQ ID NO: 1134)
DYYIH
```

CDR 2:
```
                                                           (SEQ ID NO: 1135)
WINPESGDTKYAQKFQG
```

CDR 3:
```
                                                           (SEQ ID NO: 1136)
DVSTTWSWFAP
```

TCN-554 (5277_M05) gamma heavy chain Chothia CDRs:
CDR 1:

```
                                                                    (SEQ ID NO: 1137)
GYTFTD

CDR 2:
                                                                    (SEQ ID NO: 1138)
WINPESGDTK

CDR 3:
                                                                    (SEQ ID NO: 1136)
DVSTTWSWFAP
```

TCN-554 (5277_M05) light chain variable region nucleotide sequence:
```
                                                                    (SEQ ID NO: 1139)
GACATCGTGATGACCCAGTCTCCAGACTCCCTGGCAGTGTCTCTGGGCGAGAGGGCCACCATCAACTGCAGGTCC

AGCCAGAGTATTTTCCACAACTCCAACAATGAGAACTACTTAGCTTGGTACCAGCAGAAACCAGGACAGCCTCCT

AAGCTGCTCATTTACTGGGCATCTACCCGGGAATCCGGGGTCCCTGACCGATTCAGTGGCAGCGGGTCTGGGACA

GATTTCACTCTCACCATCAGCAGCCTGCAGGCTGAAGATGTGGCGGTTTATTTCTGTCAGCAATATTATAATGCT

CCGCTCACTTTCGGCGGAGGGACCAAGGTGGAGATCAAA
```

TCN-554 (5277_M05) light chain variable region amino acid sequence (Kabat CDRs in bold, Chothia CDRs underlined)
```
                                                                    (SEQ ID NO: 1140)
DIVMTQSPDSLAVSLGERATINCRSSQSIFHNSNNENYLAWYQQKPGQPPKLLIYWASTRESGVPDRF

SGSGSGTDFTLTISSLQAEDVAVYFCQQYYNAPLTFGGGTKVEIK
```

TCN-554 (5277_M05) Light chain Kabat CDRs:
CDR 1:
```
                                                                    (SEQ ID NO: 1141)
RSSQSIFHNSNNENYLA
```

CDR 2:
```
                                                                    (SEQ ID NO: 957)
WASTRES
```

CDR 3:
```
                                                                    (SEQ ID NO: 1142)
QQYYNAPLT
```

TCN-554 (5277_M05) Light chain Chothia CDRs:
CDR 1:
```
                                                                    (SEQ ID NO: 1141)
RSSQSIFHNSNNENYLA
```

CDR 2:
```
                                                                    (SEQ ID NO: 957)
WASTRES
```

CDR 3:
```
                                                                    (SEQ ID NO: 1142)
QQYYNAPLT
```

TCN-555 (5246_L16) heavy chain variable region nucleotide sequence:
```
                                                                    (SEQ ID NO: 1143)
CAGGTGCAGCTGGTGCAGTCTGGGGCTGAGGTGAAGAGGCCTGGGTCCTCGGTGAAGGTCTCATGCACGGCTTCT

GGAGGCATCTTCAGGAAGAATGCAATCAGCTGGGTGCGACAGGCCCCTGGACAAGGCCTTGAGTGGATGGGAGGG

ATCATCGCAGTCTTTAACACAGCAAATTACGCGCAGAAGTTCCAGAACAGAGTCAAAATTACCGCAGACGAGTCA

GGCAATACGGCCTACATGGAGCTGAGCAGCCTGACATCTGACGACACGGCCGTGTATTACTGTGCGAGTCACCCA

AAATATTTCTATGGTTCGGGGAGTTATCCGGACTTCTGGGGCCAGGGAACCCTGGTCACCGTCTCGAGC
```

TCN-555 (5246_L16) gamma heavy chain variable region amino acid sequence:
(Kabat CDRs in bold, Chothia CDRs underlined)
```
                                                                    (SEQ ID NO: 1144)
QVQLVQSGAEVKRPGSSVKVSCTASGGIFRKNAISWVRQAPGQGLEWMGGIIAVFNTANYAQKFQN

RVKITADESGNTAYMELSSLTSDDTAVYYCASHPKYFYGSGSYPDFWGQGTLVTVSS
```

TCN-555 (5246_L16) gamma heavy chain Kabat CDRs:
CDR 1:
```
                                                                    (SEQ ID NO: 796)
KNAIS
```

CDR 2:

-continued

GIIAVFNTANYAQKFQN
(SEQ ID NO: 797)

CDR 3:
(SEQ ID NO: 798)
HPKYFYGSGSYPDF

TCN-555 (5246_L16) gamma heavy chain Chothia CDRs:
CDR 1:
(SEQ ID NO: 799)
GGIFRK

CDR 2:
(SEQ ID NO: 800)
GIIAVFNTAN

CDR 3:
(SEQ ID NO: 798)
HPKYFYGSGSYPDF

TCN-555 (5246_L16) light chain variable region nucleotide sequence:
(SEQ ID NO: 1145)
CAATCTGCCCTGACTCAGCCTCGCTCAGTGTCCGGGTCTCCTGGACAGTCAATCACCATCTCCTGTACTGGTGGC

AGCAGTGATATTGGTGCTTCTAACTCTGTCTCCTGGTACCAACAACACCCAGGCAAAGCCCCCAAACTCGTTATT

TTTGATGTCACTGAGCGACCCTCAGGGGTCCCGCATCGGTTCTCTGGCTCCAAGTCTGGCAACACGGCCTCCCTG

ACCGTCTCTGGGCTCCAGCCTGACGACGAGGCTGATTATTTCTGCTGCGCATATGGAGGCAAATATCTTGTGGTC

TTCGGCGGAGGGACCAAGGTGACCGTTCTA

TCN-555 (5246_L16) light chain variable region amino acid sequence (Kabat CDRs
in bold, Chothia CDRs underlined)
(SEQ ID NO: 1146)
QSALTQPRSVSGSPGQSITISCTGGSSDIGASNSVSWYQQHPGKAPKLVIFDVTERPSGVPHRFSGSKSG

NTASLTVSGLQPDDEADYFCCAYGGKYLVVFGGGTKVTVL

TCN-555 (5246_L16) Light chain Kabat CDRs:
CDR 1:
(SEQ ID NO: 1147)
TGGSSDIGASNSVS

CDR 2:
(SEQ ID NO: 804)
DVTERPS

CDR 3:
(SEQ ID NO: 805)
CAYGGKYLVV

TCN-555 (5246_L16) Light chain Chothia CDRs:
CDR 1:
(SEQ ID NO: 1147)
TGGSSDIGASNSVS

CDR 2:
(SEQ ID NO: 804)
DVTERPS

CDR 3:
(SEQ ID NO: 805)
CAYGGKYLVV

TCN-556 (5089_K12) heavy chain variable region nucleotide sequence:
(SEQ ID NO: 1148)
CAGGTGCAGCTGGTGCAGTCTGGGGCTGAGGTGAAGAAACCTGGGGCCTCAGTGAAGGTCTCCTGCAAGGCTTCT

GGATACACCTTCATCGGCTATGATATGCACTGGGTGCGACAGGCCCCTGGACAAGGGCTTGAGTGGATGGGATGG

ATCAACGCTAAAAGAGGTGGCACAAACTATGCACAAAAGTTTCAGGGCAGGGTCACCATGACCAGGGACACGTCT

ATCAGCACAGCCTACATGGAGCTGAACAGCCTGAGATCTGACGACACGGCCGTGTATTACTGTGCGAGAGGGGTG

GGGTCACGAACTACGATTTTTGGAGTTCTCAACCCGGAATTTGACTACTGGGGCCAGGGAACCCTGGTCACCGTC

TCGAGC

TCN-556 (5089_K12) gamma heavy chain variable region amino acid sequence:
(Kabat CDRs in bold, Chothia CDRs underlined)

```
                                                                   (SEQ ID NO: 1149)
QVQLVQSGAEVKKPGASVKVSCKASGYTFIGYDMHWVRQAPGQGLEWMGWINAKRGGTNYAQKF

QGRVTMTRDTSISTAYMELNSLRSDDTAVYYCARGVGSRTTIFGVLNPEFDYWGQGTLVTVSS

TCN-556 (5089_K12) gamma heavy chain Kabat CDRs:
CDR 1:
                                                                   (SEQ ID NO: 1150)
GYDMH CDR 2:
                                                                   (SEQ ID NO: 1151)
WINAKRGGTNYAQKFQG CDR 3:
                                                                   (SEQ ID NO: 1152)
GVGSRTTIFGVLNPEFDY TCN-556 (5089_K12) gamma heavy chain Chothia CDRs:
CDR 1:
                                                                   (SEQ ID NO: 1153)
GYTFIG CDR 2:
                                                                   (SEQ ID NO: 1154)
WINAKRGGTN CDR 3:
                                                                   (SEQ ID NO: 1152)
GVGSRTTIFGVLNPEFDY TCN-556 (5089_K12) light chain variable region nucleotide sequence:
                                                                   (SEQ ID NO: 1155)
CAGTCTGCCCTGACTCAGCCTCCCTCCGCGTCCGGGTCTCCTGGACAGTCAGTCACCATCTCCTGCACTGGATCC

AGCAGTGACGTTGGTGGTTATGACTATGTCTCCTGGTACCAACAACACCCAGGCAAAGCCCCCAAACTCCTGATT

TATGAGGTCACTAAGCGGCCCTCAGGGGTCCCTGATCGCTTCTCTGGCTCCAAGTCTGGCAACACGGCCTCCCTG

ACCGTCTCTGGGCTCCAGGCTGAGGATGAGGCTGATTATTACTGCAGCTCATATGCGGGCAACTACAATCATGTC

TTCGGACCTGGGACCAAGGTCACCGTTCTA

TCN-556 (5089_K12) light chain variable region amino acid sequence (Kabat CDRs
in bold, Chothia CDRs underlined)
                                                                   (SEQ ID NO: 1156)
QSALTQPPSASGSPGQSVTISCTGSSSDVGGYDYVSWYQQHPGKAPKLLIYEVTKRPSGVPDRFSGSKS

GNTASLTVSGLQAEDEADYYCSSYAGNYNHVFGPGTKVTVL

TCN-556 (5089_K12) Light chain Kabat CDRs:
CDR 1:
                                                                   (SEQ ID NO: 1157)
TGSSSDVGGYDYVS CDR 2:
                                                                   (SEQ ID NO: 1158)
EVTKRPS CDR 3:
                                                                   (SEQ ID NO: 1159)
SSYAGNYNHV TCN-556 (5089_K12) Light chain Chothia CDRs:
CDR 1:
                                                                   (SEQ ID NO: 1157)
TGSSSDVGGYDYVS CDR 2:
                                                                   (SEQ ID NO: 1158)
EVTKRPS CDR 3:
                                                                   (SEQ ID NO: 1159)
SSYAGNYNHV TCN-557 (5081_A04) heavy chain variable region nucleotide sequence:
                                                                   (SEQ ID NO: 1160)
CAGGTGCAGCTGGTGCAGTCTGGGGCTGAGGTGAAGAAGCCTGGGGCCTCAGTGAAGGTCTCCTGCAAGGCTTCT

GGACACACCTTCACCGGCTACTACATACACTGGGTGCGACAGGCCCCTGGACAAGGGCTTGAGTGGATGGGATGG
```

```
ATCAACCCTGACAGTGGTGCCACCAGTTCTGCACAGAACTTTCAGGGCAGGGTCACCATGACCGGGGACACGTCC

TCTAGCACAGCCTACATGGAGCTGAGTAGGCTGAGTTTTGACGACACGGCCGTCTATTACTGTGCGAGAGTACTG

TTTACCAGTCCTTTTGACTTCTGGGGTGAGGGAACCCTGGTCACCGTCTCGAGC
```

TCN-557 (5081_A04) gamma heavy chain variable region amino acid sequence:
(Kabat CDRs in bold, Chothia CDRs underlined)

(SEQ ID NO: 1161)
```
QVQLVQSGAEVKKPGASVKVSCKASGHTFTGYYIHWVRQAPGQGLEWMGWINPDSGATSSAQNFQ

GRVTMTGDTSSSTAYMELSRLSFDDTAVYYCARVLFTSPFDFWGEGTLVTVSS
```

TCN-557 (5081_A04) gamma heavy chain Kabat CDRs:
CDR 1:
(SEQ ID NO: 1162)
GYYIH

CDR 2:
(SEQ ID NO: 1163)
WINPDSGATSSAQNFQG

CDR 3:
(SEQ ID NO: 1164)
VLFTSPFDF

TCN-557 (5081_A04) gamma heavy chain Chothia CDRs:
CDR 1:
(SEQ ID NO: 1165)
GHTFTG

CDR 2:
(SEQ ID NO: 1166)
WINPDSGATS

CDR 3:
(SEQ ID NO: 1164)
VLFTSPFDF

TCN-557 (5081_A04) light chain variable region nucleotide sequence:
(SEQ ID NO: 1167)
```
CAGGCTGTGGTGACTCAGGAGCCCTCACTGGCTGTGTCCCCAGGAGGGACAGTCACTCTCACCTGTGGCTCCAGC

ACTGGAGCTGTCACCAGGGGTCATTATCCCTATTGGTTCCAGCAGAAGCCTGGCCAAGCCCCCAGGGCACTCATT

TATGATAGTGCAGGCAACAGACACTCCTGGACTCCCGCCCGATTCTCAGGCTCCCTCCTTGGGGGCAAAGCTGCC

CTGACCCTTTCGGGTGCGCAGCCTGAGGATGAGGCTGAGTATTACTGCTTGCTCTCCTATAGTGGTGTCTGGGTG

TTCGGCGGAGGGACGAAGCTGACCGTTCTA
```

TCN-557 (5081_A04) light chain variable region amino acid sequence (Kabat CDRs
in bold, Chothia CDRs underlined)

(SEQ ID NO: 1168)
```
QAVVTQEPSLAVSPGGTVTLTCGSSTGAVTRGHYPYWFQQKPGQAPRALIYDSAGNRHSWTPARFSG

SLLGGKAALTLSGAQPEDEAEYYCLLSYSGVWVFGGGTKLTVL
```

TCN-557 (5081_A04) Light chain Kabat CDRs:
CDR 1:
(SEQ ID NO: 1169)
GSSTGAVTRGHYPY

CDR 2:
(SEQ ID NO: 1170)
DSAGNRHS

CDR 3:
(SEQ ID NO: 1171)
LLSYSGVWV

TCN-557 (5081_A04) Light chain Chothia CDRs:
CDR 1:
(SEQ ID NO: 1169)
GSSTGAVTRGHYPY

CDR 2:

-continued

DSAGNRHS (SEQ ID NO: 1170)

CDR 3:

LLSYSGVWV (SEQ ID NO: 1171)

TCN-558 (5248_H10b) heavy chain variable region nucleotide sequence:
(SEQ ID NO: 1172)
CAGGTCCAGCTGGTGCAATCTGGGAGTGAGGTGAAGAAGCCTGGGACCTCGGTGAAGGTCTCCTGCACGGCCTCT

GGAAGTGTCTTCACCAATTATGGAATTAGTTGGGTGCGACAGGCCCCTGGACAAGGGCTTGAGTGGATGGGAGGG

ATCATCCCTCTCTTTGGCGCAGCCAAGTACGCACAGAAATTCCAGGGCAGAGTCACCATCACAGCGGACGAATCC

ACGAAGACAGTCTATATGGAGCTGAGCAGGCTGACATCTAAAGACACGGCCATATATTTCTGTGCGAAGGCCCCC

CGTGTCTACGAGTACTACTTTGATCAGTGGGGCCAGGGAACCCCAGTCACCGTCTCCTCA

TCN-558 (5248_H10b) gamma heavy chain variable region amino acid sequence:
(Kabat CDRs in bold, Chothia CDRs underlined)
(SEQ ID NO: 914)
QVQLVQSGSEVKKPGTSVKVSCTAS<u>GSVFTNYGIS</u>WVRQAPGQGLEWMGGIIPLFGAAKYAQKFQG

RVTITADESTKTVYMELSRLTSKDTAIYFCAKAPRVYEYYFDQWGQGTPVTVSS

TCN-558 (5248_H10b) gamma heavy chain Kabat CDRs:
CDR 1:
(SEQ ID NO: 915)
NYGIS

CDR 2:
(SEQ ID NO: 916)
GIIPLFGAAKYAQKFQG

CDR 3:
(SEQ ID NO: 917)
APRVYEYYFDQ

TCN-558 (5248_H10b) gamma heavy chain Chothia CDRs:
CDR 1:
(SEQ ID NO: 918)
GSVFTN

CDR 2:
(SEQ ID NO: 919)
GIIPLFGAAK

CDR 3:
(SEQ ID NO: 917)
APRVYEYYFDQ

TCN-558 (5248_H10b) light chain variable region nucleotide sequence:
(SEQ ID NO: 1173)
GAAATAGTGATGACGCAGTTTCCAGCCACCCTGTCTGTGTCTCCCGGGGAACGAGTCACCCTCTCCTGTAGGGCC

AGTCAGAGTGTTAGCAACAATTTAGCCTGGTACCAGCAAAAACCTGGCCAGCCTCCCAGGCTCCTCATCTATGAT

GCATCTACCAGGGCCACGGGTGTCCCAGCCAAGTTCAGTGGCACTGGGTCTGGCACAGAGTTCACTCTCAGCATC

AGCAGCCTGCAGTCCGAAGATTTTGCAGTTTATTACTGTCAGCAGTATCACAACTGGCCTCCCTCGTACAGTTTT

GGCCTGGGGACCAAGCTGGAGATCAAA

TCN-558 (5248_H10b) light chain variable region amino acid sequence (Kabat CDRs
in bold, Chothia CDRs underlined)
(SEQ ID NO: 862)
EIVMTQFPATLSVSPGERVTLSC<u>RASQSVSNNLA</u>WYQQKPGQPPRLLIYDASTRATGVPAKFSGTGSGT

EFTLSISSLQSEDFAVYYCQQYHNWPPSYSFGLGTKLEIK

TCN-558 (5248_H10b) Light chain Kabat CDRs:
CDR 1:
(SEQ ID NO: 863)
RASQSVSNNLA

CDR 2:
(SEQ ID NO: 864)
DASTRAT

CDR 3:

-continued

QQYHNWPPSYS (SEQ ID NO: 865)

TCN-558 (5248_H10b) Light chain Chothia CDRs:
CDR 1:
(SEQ ID NO: 863)
RASQSVSNNLA

CDR 2:
(SEQ ID NO: 864)
DASTRAT

CDR 3:
(SEQ ID NO: 865)
QQYHNWPPSYS

TCN-559 (5097_G08) heavy chain variable region nucleotide sequence:
(SEQ ID NO: 1174)
CAAGAGCAGCTGGTGCAGTCTGGGGCTGAGGTGAAGAAGCCTGGGGCCTCAGTGAAGGTCTCCTGCAAGGCTTCT

AGAAAGTCCTTCATTGGCTACTATGTACACTGGGTGCGACAGGCCCCTGGACAAGGGCTTGAGTGGATGGGATGG

ATCAGCCCTGACAGTGATGCCACAAAGTACGCACAGAAGTTTCAGGGCTCCGTCATCATGACCAGGGACACGTCC

GTCAGCACAGTGTACATGGAGCTGAGTAGGCTGACATCTGACGACACGGCCCTTTATTACTGTCTCCTTTTTCGA

GGTGGAAACTCCCTCTCCTGGGGCCAGGGAACCCTGGTCACCGTCTCGAGC

TCN-559 (5097_G08) gamma heavy chain variable region amino acid sequence:
(Kabat. CDRs in bold, Chothia CDRs underlined)
(SEQ ID NO: 1175)
QEQLVQSGAEVKKPGASVKVSCKAS<u>RKSFIGYYVH</u>WVRQAPGQGLEWMG<u>WISPDSDATKYAQKFQ</u>

GSVIMTRDTSVSTVYMELSRLTSDDTALYYCLL<u>FRGGNSLS</u>WGQGTLVTVSS

TCN-559 (5097_G08) gamma heavy chain Kabat CDRs:
CDR 1:
(SEQ ID NO: 1176)
GYYVH

CDR 2:
(SEQ ID NO: 1177)
WISPDSDATKYAQKFQG

CDR 3:
(SEQ ID NO: 1178)
FRGGNSLS

TCN-559 (5097_G08) gamma heavy chain Chothia CDRs:
CDR 1:
(SEQ ID NO: 1179)
RKSFIG

CDR 2:
(SEQ ID NO: 1180)
WISPDSDATK

CDR 3:
(SEQ ID NO: 1178)
FRGGNSLS

TCN-559 (5097_G08) light chain variable region nucleotide sequence:
(SEQ ID NO: 1181)
CAGGCTGTGGTGACTCAGGAGCCCTCACTGACTGTGTCCCCAGGAGGGACAGTCACCCTCACCTGTGGCTCCAGC

ACTGGACCTGTCACCAGTGGTCATTATCCCTACTGGTTCCAGCAGAAGCCTGGCCAAGCCCCCAGGACATTGATT

TCTGCTACATCCAACACACACTCCTGGACACCTGCCCGCTTCTCAGGCTCCCTCCTTGGGGGCAGAGCTGCCCTG

ACCCTTTCGGGTGCGCAGCCTGAGGATGAGGCTGACTATTATTGCTTTCTCTCCTACAGTGGTGCTTGGGTGTTC

GGCGGAGGGACCACGCTGACCGTTCTA

TCN-559 (5097_G08) light chain variable region amino acid sequence (Kabat CDRs
in bold, Chothia CDRs underlined)
(SEQ ID NO: 1182)
QAVVTQEPSLTVSPGGTVTLTC<u>GSSTGPVTSGHYPY</u>WFQQKPGQAPRTLIS<u>ATSNTHS</u>WTPARFSGSL LGGRAALTLSGAQPEDEADYYC<u>FLSYSGAWV</u>FGGGTTLTVL TCN-559 (5097_G08) Light chain Kabat CDRs:
CDR 1:
(SEQ ID NO: 1183)
GSSTGPVTSGHYPY

CDR 2:
(SEQ ID NO: 1184)
ATSNTHS

CDR 3:
(SEQ ID NO: 1185)
FLSYSGAWV

TCN-559 (5097_G08) Light chain Chothia CDRs:
CDR 1:
(SEQ ID NO: 1183)
GSSTGPVTSGHYPY

CDR 2:
(SEQ ID NO: 1184)
ATSNTHS

CDR 3:
(SEQ ID NO: 1185)
FLSYSGAWV

TCN-560 (5084_P10) heavy chain variable region nucleotide sequence:
(SEQ ID NO: 1186)
GAGGTGCAGCTGGTGGAATCTGGGGGAGGCTTGGTCCAGCCGGGGGGGTCCCTGAGACTCTCCTGTGCAGCCTCT

GGATTTATCTTTAGAAATTACTGGATGAGCTGGGTCCGGCAGGCTCCAGGGAAGGGGCTGGAGTGGGTGGCCAAC

ATAAAACAAGATGGAAGAGAGAAGTACTATGTGGACTCTCTGAGGGGCCGAGTCAACATCTCCAGAGACAACGCC

GAGAACTCATTGTATCTGCACATGAACAGCCTGAGAGTCGAGGACACGGCTGTTTATTTCTGTGCGAGAGCTCGG

ATGGTGGTGGTTACTGGCGATGGTTTTGATGTCTGGGGCCATGGGACAATGGTCACCGTCTCGAGC

TCN-560 (5084_P10) gamma heavy chain variable region amino acid sequence:
(Kabat CDRs in bold, Chothia CDRs underlined)
(SEQ ID NO: 1187)
EVQLVESGGGLVQPGGSLRLSCAAS<u>GFIFR</u>NYWMSWVRQAPGKGLEWVANIKQDGREKYYVDSLR

G<u>R</u>VNISRDNAENSLYLHMNSLRVEDTAVYFCAR<u>ARMVVVTGDGFDV</u>WGHGTMVTVSS

TCN-560 (5084_P10) gamma heavy chain Kabat CDRs:
CDR 1:
(SEQ ID NO: 1188)
NYWMS

CDR 2:
(SEQ ID NO: 1189)
NIKQDGREKYYVDSLRG

CDR 3:
(SEQ ID NO: 1190)
ARMVVVTGDGFDV

TCN-560 (5084_P10) gamma heavy chain Chothia CDRs:
CDR 1:
(SEQ ID NO: 1191)
GFIFRN

CDR 2:
(SEQ ID NO: 1192)
NIKQDGREKY

CDR 3:
(SEQ ID NO: 1190)
ARMVVVTGDGFDV

TCN-560 (5084_P10) light chain variable region nucleotide sequence:
(SEQ ID NO: 1193)
GACATCCAGATGACCCAGTCTCCATCCTCCCTGTCTGCATCTGTGGGAGACAGAGTCACCATCACTTGCCGGGCA

AGTCAGAATATTAAGAGGTATTTCAATTGGTATCAGCAGAAACCAGGGAAAGCCCCTAAGCTCCTGATCTATGCT

GCATCCAATTTAGAAAATGGGGTCCCATCAAGGTTCAGTGGCAGTGGATCTGGGACAGATTTCACTCTCACCATC

```
AGCAGTCTGCAACCTGAGGATTTTGCGACTTATTACTGTCAGCAGAGTTTCAGTAAATCGTGGACATTCGGCCAA

GGGACCAACGTGGACATCAAA

TCN-560 (5084_P10) light chain variable region amino acid sequence (Kabat CDRs
in bold, Chothia CDRs underlined)
                                                             (SEQ ID NO: 1194)
DIQMTQSPSSLSASVGDRVTITCRASQNIKRYFNWYQQKPGKAPKLLIYAASNLENGVPSRFSGSGSGT

DFTLTISSLQPEDFATYYCQQSFSKSWTFGQGTNVDIK

TCN-560 (5084_P10) Light chain Kabat CDRs:
CDR 1:
                                                             (SEQ ID NO: 1195)
RASQNIKRYFN CDR 2:
                                                             (SEQ ID NO: 1196)
AASNLEN CDR 3:
                                                             (SEQ ID NO: 1197)
QQSFSKSWT TCN-560 (5084_P10) Light chain Chothia CDRs:
CDR 1:
                                                             (SEQ ID NO: 1195)
RASQNIKRYFN CDR 2:
                                                             (SEQ ID NO: 1196)
AASNLEN CDR 3:
                                                             (SEQ ID NO: 1197)
QQSFSKSWT
```

The invention provides an isolated fully human monoclonal anti-HA antibody or fragment thereof, wherein said antibody includes a variable heavy chain ($V_H$) region comprising CDR1 and CDR2, wherein the $V_H$ region is encoded by a human IGHV1 (or specifically, IGHV1-18, IGHV1-2, IGHV1-69, IGHV1-8), IGHV2 (or specifically, IGHV2-5), IGHV3 (or specifically, IGHV3-30, IGHV3-33, IGHV3-49, IGHV3-53, 66, IGHV3-7), IGHV4 (or specifically, IGHV4-31, IGHV4-34, IGHV4-39, IGHV4-59, IGHV4-61), or IGHV5 (or specifically, IGHV5-51) $V_H$ germline sequence or an allele thereof, or a nucleic acid sequence that is homologous to the IGHV1, IGHV2, IGHV3, IGHV4, or IGHV5 $V_H$ germline gene sequence or an allele thereof. In one aspect, the nucleic acid sequence that is homologous to the IGHV1, IGHV2, IGHV3, IGHV4, or IGHV5 $V_H$ germline sequence is at least 75% homologous to the IGHV1, IGHV2, IGHV3, IGHV4, or IGHV5 $V_H$ germline sequence or an allele thereof. Exemplary alleles include, but are not limited to, IGHV1-18*01, IGHV1-2*02, IGHV1-2*04, IGHV1-69*01, IGHV1-69*05, IGHV1-69*06, IGHV1-69*12, IGHV1-8*01, IGHV2-5*10, IGHV3-30-3*01, IGHV3-30*03, IGHV3-30*18, IGHV3-33*05, IGHV3-49*04, IGHV3-53*01, IGHV3-66*03, IGHV3-7*01, IGHV4-31*03, IGHV4-31*06, IGHV4-34*01, IGHV4-34*02, IGHV4-34*03, IGHV4-34*12, IGHV4-39*01, IGHV4-59*01, IGHV4-59*03, IGHV4-61*01, IGHV4-61*08, and IGHV5-51*01. Exemplary sequences for each allele are provided below.

```
IGHV1-18*01 nucleotide sequence
                                                             (SEQ ID NO: 1198)
CAGGTTCAGCTGGTGCAGTCTGGAGCTGAGGTGAAGAAGCCTGGGGCCTCAGTGAAGGTCTCCTGCAAGGCTTCT

GGTTACACCTTTACCAGCTATGGTATCAGCTGGGTGCGACAGGCCCCTGGACAAGGGCTTGAGTGGATGGGATGG

ATCAGCGCTTACAATGGTAACACAAACTATGCACAGAAGCTCCAGGGCAGAGTCACCATGACCACAGACACATCC

ACGAGCACAGCCTACATGGAGCTGAGGAGCCTGAGATCTGACGACACGGCCGTGTATTACTGTGCGAGAGA

IGHV1-2*02 nucleotide sequence
                                                             (SEQ ID NO: 1199)
CAGGTGCAGCTGGTGCAGTCTGGGGCTGAGGTGAAGAAGCCTGGGGCCTCAGTGAAGGTCTCCTGCAAGGCTTCT

GGATACACCTTCACCGGCTACTATATGCACTGGGTGCGACAGGCCCCTGGACAAGGGCTTGAGTGGATGGGATGG

ATCAACCCTAACAGTGGTGGCACAAACTATGCACAGAAGTTTCAGGGCAGGGTCACCATGACCAGGGACACGTCC

ATCAGCACAGCCTACATGGAGCTGAGCAGGCTGAGATCTGACGACACGGCCGTGTATTACTGTGCGAGAGA

IGHV1-2*04 nucleotide sequence
```

-continued

```
                                                     (SEQ ID NO: 1200)
CAGGTGCAGCTGGTGCAGTCTGGGGCTGAGGTGAAGAAGCCTGGGGCCTCAGTGAAGGTCTCCTGCAAGGCTTCT

GGATACACCTTCACCGGCTACTATATGCACTGGGTGCGACAGGCCCCTGGACAAGGGCTTGAGTGGATGGGATGG

ATCAACCCTAACAGTGGTGGCACAAACTATGCACAGAAGTTTCAGGGCTGGGTCACCATGACCAGGGACACGTCC

ATCAGCACAGCCTACATGGAGCTGAGCAGGCTGAGATCTGACGACACGGCCGTGTATTACTGTGCGAGA
```

IGHV1-69*01 nucleotide sequence
```
                                                     (SEQ ID NO: 1201)
CAGGTGCAGCTGGTGCAGTCTGGGGCTGAGGTGAAGAAGCCTGGGTCCTCGGTGAAGGTCTCCTGCAAGGCTTCT

GGAGGCACCTTCAGCAGCTATGCTATCAGCTGGGTGCGACAGGCCCCTGGACAAGGGCTTGAGTGGATGGGAGGG

ATCATCCCTATCTTTGGTACAGCAAACTACGCACAGAAGTTCCAGGGCAGAGTCACGATTACCGCGGACGAATCC

ACGAGCACAGCCTACATGGAGCTGAGCAGCCTGAGATCTGAGGACACGGCCGTGTATTACTGTGCGAGAGA
```

IGHV1-69*05 nucleotide sequence
```
                                                     (SEQ ID NO: 1202)
CAGGTCCAGCTGGTGCAGTCTGGGGCTGAGGTGAAGAAGCCTGGGTCCTCGGTGAAGGTCTCCTGCAAGGCTTCT

GGAGGCACCTTCAGCAGCTATGCTATCAGCTGGGTGCGACAGGCCCCTGGACAAGGGCTTGAGTGGATGGGAGGG

ATCATCCCTATCTTTGGTACAGCAAACTACGCACAGAAGTTCCAGGGCAGAGTCACGATTACCACGGACGAATCC

ACGAGCACAGCCTACATGGAGCTGAGCAGCCTGAGATCTGAGGACACGGCCGTGTATTACTGTGCGAGA
```

IGHV1-69*06 nucleotide sequence
```
                                                     (SEQ ID NO: 1203)
CAGGTGCAGCTGGTGCAGTCTGGGGCTGAGGTGAAGAAGCCTGGGTCCTCGGTGAAGGTCTCCTGCAAGGCTTCT

GGAGGCACCTTCAGCAGCTATGCTATCAGCTGGGTGCGACAGGCCCCTGGACAAGGGCTTGAGTGGATGGGAGGG

ATCATCCCTATCTTTGGTACAGCAAACTACGCACAGAAGTTCCAGGGCAGAGTCACGATTACCGCGGACAAATCC

ACGAGCACAGCCTACATGGAGCTGAGCAGCCTGAGATCTGAGGACACGGCCGTGTATTACTGTGCGAGAGA
```

IGHV1-69*12 nucleotide sequence
```
                                                     (SEQ ID NO: 1204)
CAGGTCCAGCTGGTGCAGTCTGGGGCTGAGGTGAAGAAGCCTGGGTCCTCGGTGAAGGTCTCCTGCAAGGCTTCT

GGAGGCACCTTCAGCAGCTATGCTATCAGCTGGGTGCGACAGGCCCCTGGACAAGGGCTTGAGTGGATGGGAGGG

ATCATCCCTATCTTTGGTACAGCAAACTACGCACAGAAGTTCCAGGGCAGAGTCACGATTACCGCGGACGAATCC

ACGAGCACAGCCTACATGGAGCTGAGCAGCCTGAGATCTGAGGACACGGCCGTGTATTACTGTGCGAGAGA
```

IGHV1-8*01 nucleotide sequence
```
                                                     (SEQ ID NO: 1205)
CAGGTGCAGCTGGTGCAGTCTGGGGCTGAGGTGAAGAAGCCTGGGGCCTCAGTGAAGGTCTCCTGCAAGGCTTCT

GGATACACCTTCACCAGTTATGATATCAACTGGGTGCGACAGGCCACTGGACAAGGGCTTGAGTGGATGGGATGG

ATGAACCCTAACAGTGGTAACACAGGCTATGCACAGAAGTTCCAGGGCAGAGTCACCATGACCAGGAACACCTCC

ATAAGCACAGCCTACATGGAGCTGAGCAGCCTGAGATCTGAGGACACGGCCGTGTATTACTGTGCGAGAGG
```

IGHV2-5*10 nucleotide sequence
```
                                                     (SEQ ID NO: 1206)
CAGATCACCTTGAAGGAGTCTGGTCCTACGCTGGTGAAACCCACACAGACCCTCACGCTGACCTGCACCTTCTCT

GGGTTCTCACTCAGCACTAGTGGAGTGGGTGTGGGCTGGATCCGTCAGCCCCCAGGAAAGGCCCTGGAGTGGCTT

GCACTCATTTATTGGGATGATGATAAGCGCTACAGCCCATCTCTGAAGAGCAGGCTCACCATCACCAAGGACACC

TCCAAAAACCAGGTGGTCCTTACAATGACCAACATGGACCCTGTGGACACAGCCACATATTACTGTGCACGG
```

IGHV3-30-3*01 nucleotide sequence
```
                                                     (SEQ ID NO: 1207)
CAGGTGCAGCTGGTGGAGTCTGGGGGAGGCGTGGTCCAGCCTGGGAGGTCCCTGAGACTCTCCTGTGCAGCCTCT

GGATTCACCTTCAGTAGCTATGCTATGCACTGGGTCCGCCAGGCTCCAGGCAAGGGGCTGGAGTGGGTGGCAGTT

ATATCATATGATGGAAGCAATAAATACTACGCAGACTCCGTGAAGGGCCGATTCACCATCTCCAGAGACAATTCC

AAGAACACGCTGTATCTGCAAATGAACAGCCTGAGAGCTGAGGACACGGCTGTGTATTACTGTGCGAGA
```

IGHV3-30*03 nucleotide sequence

-continued (SEQ ID NO: 1208)
CAGGTGCAGCTGGTGGAGTCTGGGGGAGGCGTGGTCCAGCCTGGGAGGTCCCTGAGACTCTCCTGTGCAGCCTCT

GGATTCACCTTCAGTAGCTATGGCATGCACTGGGTCCGCCAGGCTCCAGGCAAGGGGCTGGAGTGGGTGGCAGTT

ATATCATATGATGGAAGTAATAAATACTATGCAGACTCCGTGAAGGGCCGATTCACCATCTCCAGAGACAATTCC

AAGAACACGCTGTATCTGCAAATGAACAGCCTGAGAGCTGAGGACACGGCTGTGTATTACTGTGCGAGAGA

IGHV3-30*18 nucleotide sequence (SEQ ID NO: 1209)
CAGGTGCAGCTGGTGGAGTCTGGGGGAGGCGTGGTCCAGCCTGGGAGGTCCCTGAGACTCTCCTGTGCAGCCTCT

GGATTCACCTTCAGTAGCTATGGCATGCACTGGGTCCGCCAGGCTCCAGGCAAGGGGCTGGAGTGGGTGGCAGTT

ATATCATATGATGGAAGTAATAAATACTATGCAGACTCCGTGAAGGGCCGATTCACCATCTCCAGAGACAATTCC

AAGAACACGCTGTATCTGCAAATGAACAGCCTGAGAGCTGAGGACACGGCTGTGTATTACTGTGCGAAAGA

IGHV3-33*05 nucleotide sequence (SEQ ID NO: 1210)
CAGGTGCAGCTGGTGGAGTCTGGGGGAGGCGTGGTCCAGCCTGGGAGGTCCCTGAGACTCTCCTGTGCAGCGTCT

GGATTCACCTTCAGTAGCTATGGCATGCACTGGGTCCGCCAGGCTCCAGGCAAGGGGCTGGAGTGGGTGGCAGTT

ATATCATATGATGGAAGTAATAAATACTATGCAGACTCCGTGAAGGGCCGATTCACCATCTCCAGAGACAATTCC

AAGAACACGCTGTATCTGCAAATGAACAGCCTGAGAGCCGAGGACACGGCTGTGTATTACTGTGCGAGAGA

IGHV3-49*04 nucleotide sequence (SEQ ID NO: 1211)
GAGGTGCAGCTGGTGGAGTCTGGGGGAGGCTTGGTACAGCCAGGGCGGTCCCTGAGACTCTCCTGTACAGCTTCT

GGATTCACCTTTGGTGATTATGCTATGAGCTGGGTCCGCCAGGCTCCAGGGAAGGGGCTGGAGTGGGTAGGTTTC

ATTAGAAGCAAAGCTTATGGTGGGACAACAGAATACGCCGCGTCTGTGAAAGGCAGATTCACCATCTCAAGAGAT

GATTCCAAAAGCATCGCCTATCTGCAAATGAACAGCCTGAAAACCGAGGACACAGCCGTGTATTACTGTACTAGA

GA

IGHV3-53*01 nucleotide sequence (SEQ ID NO: 1212)
GAGGTGCAGCTGGTGGAGTCTGGAGGAGGCTTGATCCAGCCTGGGGGGTCCCTGAGACTCTCCTGTGCAGCCTCT

GGGTTCACCGTCAGTAGCAACTACATGAGCTGGGTCCGCCAGGCTCCAGGGAAGGGGCTGGAGTGGGTCTCAGTT

ATTTATAGCGGTGGTAGCACATACTACGCAGACTCCGTGAAGGGCCGATTCACCATCTCCAGAGACAATTCCAAG

AACACGCTGTATCTTCAAATGAACAGCCTGAGAGCCGAGGACACGGCCGTGTATTACTGTGCGAGAGA

IGHV3-66*03 nucleotide sequence (SEQ ID NO: 1213)
CAGGTGCAGCTGGTGCAGTCTGGCCATGAGGTGAAGCAGCCTGGGGCCTCAGTGAAGGTCTCCTGCAAGGCTTCT

GGTTACAGTTTCACCACCTATGGTATGAATTGGGTGCCACAGGCCCCTGGACAAGGGCTTGAGTGGATGGGATGG

TTCAACACCTACACTGGGAACCCAACATATGCCCAGGGCTTCACAGGACGGTTTGTCTTCTCCATGGACACCTCT

GCCAGCACAGCATACCTGCAGATCAGCAGCCTAAAGGCTGAGGACATGGCCATGTATTACTGTGCGAGATA

IGHV3-7*01 nucleotide sequence (SEQ ID NO: 1214)
GAGGTGCAGCTGGTGGAGTCTGGGGGAGGCTTGGTCCAGCCTGGGGGGTCCCTGAGACTCTCCTGTGCAGCCTCT

GGATTCACCTTTAGTAGCTATTGGATGAGCTGGGTCCGCCAGGCTCCAGGGAAGGGGCTGGAGTGGGTGGCCAAC

ATAAAGCAAGATGGAAGTGAGAAATACTATGTGGACTCTGTGAAGGGCCGATTCACCATCTCCAGAGACAACGCC

AAGAACTCACTGTATCTGCAAATGAACAGCCTGAGAGCCGAGGACACGGCTGTGTATTACTGTGCGAGAGA

IGHV4-31*03 nucleotide sequence (SEQ ID NO: 1215)
CAGGTGCAGCTGCAGGAGTCGGGCCCAGGACTGGTGAAGCCTTCACAGACCCTGTCCCTCACCTGCACTGTCTCT

GGTGGCTCCATCAGCAGTGGTGGTTACTACTGGAGCTGGATCCGCCAGCACCCAGGGAAGGGCCTGGAGTGGATT

GGGTACATCTATTACAGTGGGAGCACCTACTACAACCCGTCCCTCAAGAGTCGAGTTACCATATCAGTAGACACG

TCTAAGAACCAGTTCTCCCTGAAGCTGAGCTCTGTGACTGCCGCGGACACGGCCGTGTATTACTGTGCGAGAGA

IGHV4-31*06 nucleotide sequence
(SEQ ID NO: 1216)
CAGGTGCAGCTGCAGGAGTCGGGCCCAGGACTGGTGAAGCCTTCACAGACCCTGTCCCTCACCTGCACTGTCTCT
GGTGGCTCCATCAGCAGTGGTAGTTACTACTGGAGCTGGATCCGCCAGCACCCAGGGAAGGGCCTGGAGTGGATT
GGGTACATCTATTACAGTGGGAGCACCTACTACAACCCGTCCCTCAAGAGTCGAGTTACCATATCAGTAGACACG
TCTAAGAACCAGTTCTCCCTGAAGCTGAGCTCTGTGACTGCCGCGGACACGGCCGTGTATTACTG IGHV4-34*01 nucleotide sequence
(SEQ ID NO: 1217)
CAGCTGCAGCTGCAGGAGTCGGGCCCAGGACTGGTGAAGCCTTCGGAGACCCTGTCCCTCACCTGCACTGTCTCT
GGTGGCTCCATCAGCAGTAGTAGTTACTACTGGGGCTGGATCCGCCAGCCCCCAGGGAAGGGGCTGGAGTGGATT
GGGAGTATCTATTATAGTGGGAGCACCTACTACAACCCGTCCCTCAAGAGTCGAGTCACCATATCCGTAGACACG
TCCAAGAACCAGTTCTCCCTGAAGCTGAGCTCTGTGACCGCCGCAGACACGGCTGTGTATTACTGTGCGAGACA IGHV4-34*02 nucleotide sequence
(SEQ ID NO: 1218)
CAGGTGCAGCTACAACAGTGGGGCGCAGGACTGTTGAAGCCTTCGGAGACCCTGTCCCTCACCTGCGCTGTCTAT
GGTGGGTCCTTCAGTGGTTACTACTGGAGCTGGATCCGCCAGCCCCCAGGGAAGGGGCTGGAGTGGATTGGGGAA
ATCAATCATAGTGGAAGCACCAACTACAACCCGTCCCTCAAGAGTCGAGTCACCATATCAGTAGACACGTCCAAG
AACCAGTTCTCCCTGAAGCTGAGCTCTGTGACCGCCGCGGACACGGCTGTGTATTACTGTGCGAGAGG IGHV4-34*03 nucleotide sequence
(SEQ ID NO: 1219)
CAGGTGCAGCTACAGCAGTGGGGCGCAGGACTGTTGAAGCCTTCGGAGACCCTGTCCCTCACCTGCGCTGTCTAT
GGTGGGTCCTTCAGTGGTTACTACTGGAGCTGGATCCGCCAGCCCCCAGGGAAGGGGCTGGAGTGGATTGGGGAA
ATCAATCATAGTGGAAGCACCAACTACAACCCGTCCCTCAAGAGTCGAGTCACCATATCAGTAGACACGTCCAAG
AACCAGTTCTCCCTGAAGCTGAGCTCTGTGACCGCCGCGGACACGGCCGTGTATTACTG IGHV4-34*12 nucleotide sequence
(SEQ ID NO: 1220)
CAGGTGCAGCTACAGCAGTGGGGCGCAGGACTGTTGAAGCCTTCGGAGACCCTGTCCCTCACCTGCGCTGTCTAT
GGTGGGTCCTTCAGTGGTTACTACTGGAGCTGGATCCGCCAGCCCCCAGGGAAGGGGCTGGAGTGGATTGGGGAA
ATCATTCATAGTGGAAGCACCAACTACAACCCGTCCCTCAAGAGTCGAGTCACCATATCAGTAGACACGTCCAAG
AACCAGTTCTCCCTGAAGCTGAGCTCTGTGACCGCCGCGGACACGGCTGTGTATTACTGTGCGAGA IGHV4-39*01 nucleotide sequence
(SEQ ID NO: 1221)
CAGCTGCAGCTGCAGGAGTCGGGCCCAGGACTGGTGAAGCCTTCGGAGACCCTGTCCCTCACCTGCACTGTCTCT
GGTGGCTCCATCAGCAGTAGTAGTTACTACTGGGGCTGGATCCGCCAGCCCCCAGGGAAGGGGCTGGAGTGGATT
GGGAGTATCTATTATAGTGGGAGCACCTACTACAACCCGTCCCTCAAGAGTCGAGTCACCATATCCGTAGACACG
TCCAAGAACCAGTTCTCCCTGAAGCTGAGCTCTGTGACCGCCGCAGACACGGCTGTGTATTACTGTGCGAGACA IGHV4-59*01 nucleotide sequence
(SEQ ID NO: 1222)
GAGGTGCAGCTGGTGGAGTCTGGGGGAGGCTTAGTAAAGACTGGAGGGGTCTCTGAGACTCTCCTGTGCAGCCTC
TGGATTCACCTTCAGTAGCTCTGCTATGCACTGGGTCCACCAGGCTCCAGGAAAGGGTTTGGAGTGGGTCTCAGT
TATTAGTACAAGTGGTGATACCGTACTCTACACAGACTCTGTGAAGGGCTGATTCACCATCTCTAGAGACAATGC
CCAGAATTCACTGTATCTGCAAATGAACAGCCTGAGAGCCGACGACATGGCTGTGTATTACTGTGTGAAAGA IGHV4-59*03 nucleotide sequence
(SEQ ID NO: 1223)
CAGGTGCAGCTGCAGGAGTCGGGCCCAGGACTGGTGAAGCCTTCGGAGACCCTGTCCCTCACCTGCACTGTCTCT
GGTGGCTCCATCAGTAGTTACTACTGGAGCTGGATCCGGCAGCCCCCAGGGAAGGGACTGGAGTGGATTGGGTAT
ATCTATTACAGTGGGAGCACCAACTACAACCCCTCCCTCAAGAGTCGAGTCACCATATCAGTAGACACGTCCAAG
AACCAATTCTCCCTGAAGCTGAGCTCTGTGACCGCTGCGGACACGGCCGTGTATTACTGTGCG

```
IGHV4-61*01 nucleotide sequence
                                                         (SEQ ID NO: 1224)
CAGGTGCAGCTGCAGGAGTCGGGCCCAGGACTGGTGAAGCCTTCGGAGACCCTGTCCCTCACCTGCACTGTCTCT

GGTGGCTCCGTCAGCAGTGGTAGTTACTACTGGAGCTGGATCCGGCAGCCCCCAGGGAAGGGACTGGAGTGGATT

GGGTATATCTATTACAGTGGGAGCACCAACTACAACCCCTCCCTCAAGAGTCGAGTCACCATATCAGTAGACACG

TCCAAGAACCAGTTCTCCCTGAAGCTGAGCTCTGTGACCGCTGCGGACACGGCCGTGTATTACTGTGCGAGAGA

IGHV4-61*08 nucleotide sequence
                                                         (SEQ ID NO: 1225)
CAGGTGCAGCTGGTGCAGTCTGGCCATGAGGTGAAGCAGCCTGGGGCCTCAGTGAAGGTCTCCTGCAAGGCTTCT

GGTTACAGTTTCACCACCTATGGTATGAATTGGGTGCCACAGGCCCCTGGACAAGGGCTTGAGTGGATGGGATGG

TTCAACACCTACACTGGGAACCCAACATATGCCCAGGGCTTCACAGGACGGTTTGTCTTCTCCATGGACACCTCT

GCCAGCACAGCATACCTGCAGATCAGCAGCCTAAAGGCTGAGGACATGGCCATGTATTACTGTGCGAGATA

IGHV5-51*01 nucleotide sequence
                                                         (SEQ ID NO: 1226)
GAGGTGCAGCTGGTGCAGTCTGGAGCAGAGGTGAAAAAGCCCGGGGAGTCTCTGAAGATCTCCTGTAAGGGTTCT

GGATACAGCTTTACCAGCTACTGGATCGGCTGGGTGCGCCAGATGCCCGGGAAAGGCCTGGAGTGGATGGGGATC

ATCTATCCTGGTGACTCTGATACCAGATACAGCCCGTCCTTCCAAGGCCAGGTCACCATCTCAGCCGACAAGTCC

ATCAGCACCGCCTACCTGCAGTGGAGCAGCCTGAAGGCCTCGGACACCGCCATGTATTACTGTGCGAGACA
```

In certain embodiments of the invention, the antibody further includes a variable light chain (VL) region encoded by a human IGKV1 (or specifically, IGKV1-17, IGKV1-27, IGKV1-39, IGKV1D-39, IGKV1-5), IGKV2 (or specifically, IGKV2-30), IGKV3 (or specifically, IGKV3-11, IGKV3-15, IGKV3-20), IGKV4 (or specifically, IGKV4-1, IGKV4-1), IGLV1 (or specifically, IGLV1-40, IGLV1-44, IGLV1-55), IGLV2 (or specifically, IGLV2-11, IGLV2-14, IGLV2-8), IGLV3 (or specifically, IGLV3-21 or IGLV3-25), IGLV7 (or specifically, IGLV7-43 or IGLV7-46), or IGLV9 (or specifically, IGLV9-49) or an allele thereof. $V_L$ germline gene sequence IGKV1, IGKV2, IGKV3, IGKV4, IGLV1, IGLV2, IGLV3, IGLV7, or IGLV9 or an allele thereof, or a nucleotide acid sequence that is homologous to the IGKV1, IGKV2, IGKV3, IGKV4, IGLV1, IGLV2, IGLV3, IGLV7, or IGLV9 $V_L$ germline gene sequence or an allele thereof. Furthermore, the nucleic acid sequence that is homologous to the IGKV1, IGKV2, IGKV3, IGKV4, IGLV1, IGLV2, IGLV3, IGLV7, or IGLV9 $V_L$ germline sequence or an allele thereof is at least 65% homologous to the IGKV1, IGKV2, IGKV3, IGKV4, IGLV1, IGLV2, IGLV3, IGLV7, or IGLV9 $V_L$ germline sequence or an allele thereof.

```
IGKV1-17*01 nucleotide sequence
                                                         (SEQ ID NO: 1227)
GACATCCAGATGACCCAGTCTCCATCCTCCCTGTCTGCATCTGTAGGAGACAGAGTCACCATCACTTGCCGGGCA

AGTCAGGGCATTAGAAATGATTTAGGCTGGTATCAGCAGAAACCAGGGAAAGCCCCTAAGCGCCTGATCTATGCT

GCATCCAGTTTGCAAAGTGGGGTCCCATCAAGGTTCAGCGGCAGTGGATCTGGGACAGAATTCACTCTCACAATC

AGCAGCCTGCAGCCTGAAGATTTTGCAACTTATTACTGTCTACAGCATAATAGTTACCCTCC

IGKV1-27*01 nucleotide sequence
                                                         (SEQ ID NO: 1228)
GACATCCAGATGACCCAGTCTCCATCCTCCCTGTCTGCATCTGTAGGAGACAGAGTCACCATCACTTGCCGGGCG

AGTCAGGGCATTAGCAATTATTTAGCCTGGTATCAGCAGAAACCAGGGAAAGTTCCTAAGCTCCTGATCTATGCT

GCATCCACTTTGCAATCAGGGGTCCCATCTCGGTTCAGTGGCAGTGGATCTGGGACAGATTTCACTCTCACCATC

AGCAGCCTGCAGCCTGAAGATGTTGCAACTTATTACTGTCAAAAGTATAACAGTGCCCCTCC

IGKV1-39*01 nucleotide sequence
                                                         (SEQ ID NO: 1229)
GACATCCAGATGACCCAGTCTCCATCCTCCCTGTCTGCATCTGTAGGAGACAGAGTCACCATCACTTGCCGGGCA

AGTCAGAGCATTAGCAGCTATTTAAATTGGTATCAGCAGAAACCAGGGAAAGCCCCTAAGCTCCTGATCTATGCT

GCATCCAGTTTGCAAAGTGGGGTCCCATCAAGGTTCAGTGGCAGTGGATCTGGGACAGATTTCACTCTCACCATC

AGCAGTCTGCAACCTGAAGATTTTGCAACTTACTACTGTCAACAGAGTTACAGTACCCCTCC

IGKV1D-39*01 nucleotide sequence
```

-continued (SEQ ID NO: 1230)
GACATCCAGATGACCCAGTCTCCATCCTCCCTGTCTGCATCTGTAGGAGACAGAGTCACCATCACTTGCCGGGCA
AGTCAGAGCATTAGCAGCTATTTAAATTGGTATCAGCAGAAACCAGGGAAAGCCCCTAAGCTCCTGATCTATGCT
GCATCCAGTTTGCAAAGTGGGGTCCCATCAAGGTTCAGTGGCAGTGGATCTGGGACAGATTTCACTCTCACCATC
AGCAGTCTGCAACCTGAAGATTTTGCAACTTACTACTGTCAACAGAGTTACAGTACCCCTCC IGKV1-5*03 nucleotide sequence (SEQ ID NO: 1231)
GACATCCAGATGACCCAGTCTCCTTCCACCCTGTCTGCATCTGTAGGAGACAGAGTCACCATCACTTGCCGGGCC
AGTCAGAGTATTAGTAGCTGGTTGGCCTGGTATCAGCAGAAACCAGGGAAAGCCCCTAAGCTCCTGATCTATAAG
GCGTCTAGTTTAGAAAGTGGGGTCCCATCAAGGTTCAGCGGCAGTGGATCTGGGACAGAATTCACTCTCACCATC
AGCAGCCTGCAGCCTGATGATTTTGCAACTTATTACTGCCAACAGTATAATAGTTATTCTCC IGKV2-30*02 nucleotide sequence (SEQ ID NO: 1232)
GATGTTGTGATGACTCAGTCTCCACTCTCCCTGCCCGTCACCCTTGGACAGCCGGCCTCCATCTCCTGCAGGTCT
AGTCAAAGCCTCGTACACAGTGATGGAAACACCTACTTGAATTGGTTTCAGCAGAGGCCAGGCCAATCTCCAAGG
CGCCTAATTTATAAGGTTTCTAACCGGGACTCTGGGGTCCCAGACAGATTCAGCGGCAGTGGGTCAGGCACTGAT
TTCACACTGAAAATCAGCAGGGTGGAGGCTGAGGATGTTGGGGTTTATTACTGCATGCAAGGTACACACTGGCCT
CC IGKV3-11*01 nucleotide sequence (SEQ ID NO: 1233)
GAAATTGTGTTGACACAGTCTCCAGCCACCCTGTCTTTGTCTCCAGGGGAAAGAGCCACCCTCTCCTGCAGGGCC
AGTCAGAGTGTTAGCAGCTACTTAGCCTGGTACCAACAGAAACCTGGCCAGGCTCCCAGGCTCCTCATCTATGAT
GCATCCAACAGGGCCACTGGCATCCCAGCCAGGTTCAGTGGCAGTGGGTCTGGGACAGACTTCACTCTCACCATC
AGCAGCCTAGAGCCTGAAGATTTTGCAGTTTATTACTGTCAGCAGCGTAGCAACTGGCCTCC IGKV3-15*01 nucleotide sequence (SEQ ID NO: 1234)
GAAATAGTGATGACGCAGTCTCCAGCCACCCTGTCTGTGTCTCCAGGGGAAAGAGCCACCCTCTCCTGCAGGGCC
AGTCAGAGTGTTAGCAGCAACTTAGCCTGGTACCAGCAGAAACCTGGCCAGGCTCCCAGGCTCCTCATCTATGGT
GCATCCACCAGGGCCACTGGTATCCCAGCCAGGTTCAGTGGCAGTGGGTCTGGGACAGAGTTCACTCTCACCATC
AGCAGCCTGCAGTCTGAAGATTTTGCAGTTTATTACTGTCAGCAGTATAATAACTGGCCTCC IGKV3-20*01 nucleotide sequence (SEQ ID NO: 1235)
GAAATTGTGTTGACGCAGTCTCCAGGCACCCTGTCTTTGTCTCCAGGGGAAAGAGCCACCCTCTCCTGCAGGGCC
AGTCAGAGTGTTAGCAGCAGCTACTTAGCCTGGTACCAGCAGAAACCTGGCCAGGCTCCCAGGCTCCTCATCTAT
GGTGCATCCAGCAGGGCCACTGGCATCCCAGACAGGTTCAGTGGCAGTGGGTCTGGGACAGACTTCACTCTCACC
ATCAGCAGACTGGAGCCTGAAGATTTTGCAGTGTATTACTGTCAGCAGTATGGTAGCTCACCTCC IGKV4-1*01 nucleotide sequence (SEQ ID NO: 1236)
GACATCGTGATGACCCAGTCTCCAGACTCCCTGGCTGTGTCTCTGGGCGAGAGGGCCACCATCAACTGCAAGTCC
AGCCAGAGTGTTTTATACAGCTCCAACAATAAGAACTACTTAGCTTGGTACCAGCAGAAACCAGGACAGCCTCCT
AAGCTGCTCATTTACTGGGCATCTACCCGGGAATCCGGGGTCCCTGACCGATTCAGTGGCAGCGGGTCTGGGACA
GATTTCACTCTCACCATCAGCAGCCTGCAGGCTGAAGATGTGGCAGTTTATTACTGTCAGCAATATTATAGTACT
CCTCC IGLV1-40*01 nucleotide sequence (SEQ ID NO: 1237)
CAGTCTGTGCTGACGCAGCCGCCCTCAGTGTCTGGGGCCCCAGGGCAGAGGGTCACCATCTCCTGCACTGGGAGC
AGCTCCAACATCGGGGCAGGTTATGATGTACACTGGTACCAGCAGCTTCCAGGAACAGCCCCCAAACTCCTCATC
TATGGTAACAGCAATCGGCCCTCAGGGGTCCCTGACCGATTCTCTGGCTCCAAGTCTGGCACCTCAGCCTCCCTG -continued

GCCATCACTGGGCTCCAGGCTGAGGATGAGGCTGATTATTACTGCCAGTCCTATGACAGCAGCCTGAGTGGTTC

IGLV1-44*01 nucleotide sequence (SEQ ID NO: 1238)

CAGTCTGTGCTGACTCAGCCACCCTCAGCGTCTGGGACCCCCGGGCAGAGGGTCACCATCTCTTGTTCTGGAAGC

AGCTCCAACATCGGAAGTAATACTGTAAACTGGTACCAGCAGCTCCCAGGAACGGCCCCCAAACTCCTCATCTAT

AGTAATAATCAGCGGCCCTCAGGGGTCCCTGACCGATTCTCTGGCTCCAAGTCTGGCACCTCAGCCTCCCTGGCC

ATCAGTGGGCTCCAGTCTGAGGATGAGGCTGATTATTACTGTGCAGCATGGGATGACAGCCTGAATGGTCC

IGLV1-51*02 nucleotide sequence (SEQ ID NO: 1239)

CAGTCTGTGTTGACGCAGCCGCCCTCAGTGTCTGCGGCCCCAGGACAGAAGGTCACCATCTCCTGCTCTGGAAGC

AGCTCCAACATTGGGAATAATTATGTATCCTGGTACCAGCAGCTCCCAGGAACAGCCCCCAAACTCCTCATCTAT

GAAAATAATAAGCGACCCTCAGGGATTCCTGACCGATTCTCTGGCTCCAAGTCTGGCACGTCAGCCACCCTGGGC

ATCACCGGACTCCAGACTGGGGACGAGGCCGATTATTACTGCGGAACATGGGATAGCAGCCTGAGTGCTGG

IGLV2-11*01 nucleotide sequence (SEQ ID NO: 1240)

CAGTCTGCCCTGACTCAGCCTCGCTCAGTGTCCGGGTCTCCTGGACAGTCAGTCACCATCTCCTGCACTGGAACC

AGCAGTGATGTTGGTGGTTATAACTATGTCTCCTGGTACCAACAGCACCCAGGCAAAGCCCCCAAACTCATGATT

TATGATGTCAGTAAGCGGCCCTCAGGGGTCCCTGATCGCTTCTCTGGCTCCAAGTCTGGCAACACGGCCTCCCTG

ACCATCTCTGGGCTCCAGGCTGAGGATGAGGCTGATTATTACTGCTGCTCATATGCAGGCAGCTACACTTTC

IGLV2-14*01 nucleotide sequence (SEQ ID NO: 1241)

CAGTCTGCCCTGACTCAGCCTGCCTCCGTGTCTGGGTCTCCTGGACAGTCGATCACCATCTCCTGCACTGGAACC

AGCAGTGACGTTGGTGGTTATAACTATGTCTCCTGGTACCAACAGCACCCAGGCAAAGCCCCCAAACTCATGATT

TATGAGGTCAGTAATCGGCCCTCAGGGGTTTCTAATCGCTTCTCTGGCTCCAAGTCTGGCAACACGGCCTCCCTG

ACCATCTCTGGGCTCCAGGCTGAGGACGAGGCTGATTATTACTGCAGCTCATATACAAGCAGCAGCACTCTC

IGLV2-8*01 nucleotide sequence (SEQ ID NO: 1242)

CAGTCTGCCCTGACTCAGCCTCCCTCCGCGTCCGGGTCTCCTGGACAGTCAGTCACCATCTCCTGCACTGGAACC

AGCAGTGACGTTGGTGGTTATAACTATGTCTCCTGGTACCAACAGCACCCAGGCAAAGCCCCCAAACTCATGATT

TATGAGGTCAGTAAGCGGCCCTCAGGGGTCCCTGATCGCTTCTCTGGCTCCAAGTCTGGCAACACGGCCTCCCTG

ACCGTCTCTGGGCTCCAGGCTGAGGATGAGGCTGATTATTACTGCAGCTCATATGCAGGCAGCAACAATTTC

IGLV3-21*02 nucleotide sequence (SEQ ID NO: 1243)

TCCTATGAGCTGACACAGCTACCCTCGGTGTCAGTGTCCCCAGGACAGACAGCCAGGATCACCTGCTCTGGAGAT

GTACTGGGGGAAAATTATGCTGACTGGTACCAGCAGAAGCCAGGCCAGGCCCCTGAGTTGGTGATATACGAAGAT

AGTGAGCGGTACCCTGGAATCCCTGAACGATTCTCTGGGTCCACCTCAGGGAACACGACCACCCTGACCATCAGC

AGGGTCCTGACCGAAGACGAGGCTGACTATTACTGTTTGTCTGGGGATGAGGACAATCC

IGLV3-25*03 nucleotide sequence (SEQ ID NO: 1244)

TCCTATGAGCTGACACAGCCACCCTCGGTGTCAGTGTCCCCAGGACAGACGGCCAGGATCACCTGCTCTGGAGAT

GCATTGCCAAAGCAATATGCTTATTGGTACCAGCAGAAGCCAGGCCAGGCCCCTGTGCTGGTGATATATAAAGAC

AGTGAGAGGCCCTCAGGGATCCCTGAGCGATTCTCTGGCTCCAGCTCAGGGACAACAGTCACGTTGACCATCAGT

GGAGTCCAGGCAGAAGACGAGGCTGACTATTACTGTCAATCAGCAGACAGCAGTGGT

IGLV7-43*01 nucleotide sequence (SEQ ID NO: 1245)

CAGACTGTGGTGACTCAGGAGCCCTCACTGACTGTGTCCCCAGGAGGGACAGTCACTCTCACCTGTGCTTCCAGC

ACTGGAGCAGTCACCAGTGGTTACTATCCAAACTGGTTCCAGCAGAAACCTGGACAAGCACCCAGGGCACTGATT

TATAGTACAAGCAACAAACACTCCTGGACCCCTGCCCGGTTCTCAGGCTCCCTCCTTGGGGGCAAAGCTGCCCTG

```
ACACTGTCAGGTGTGCAGCCTGAGGACGAGGCTGAGTATTACTGCCTGCTCTACTATGGTGGTGCTCAG

IGLV7-46*01 nucleotide sequence
                                                        (SEQ ID NO: 1246)
CAGGCTGTGGTGACTCAGGAGCCCTCACTGACTGTGTCCCCAGGAGGGACAGTCACTCTCACCTGTGGCTCCAGC

ACTGGAGCTGTCACCAGTGGTCATTATCCCTACTGGTTCCAGCAGAAGCCTGGCCAAGCCCCCAGGACACTGATT

TATGATACAAGCAACAAACACTCCTGGACACCTGCCCGGTTCTCAGGCTCCCTCCTTGGGGGCAAAGCTGCCCTG

ACCCTTTCGGGTGCGCAGCCTGAGGATGAGGCTGAGTATTACTGCTTGCTCTCCTATAGTGGTGCTCGG

IGLV7-46*02 nucleotide sequence
                                                        (SEQ ID NO: 1247)
CAGGCTGTGGTGACTCAGGAGCCCTCACTGACTGTGTCCCCAGGAGGGACAGTCACTCTCACCTGTGGCTCCAGC

ACTGGAGCTGTCACCAGTGGTCATTATCCCTACTGGTTCCAGCAGAAGCCTGGCCAAGCCCCCAGGACACTGATT

TATGATACAAGCAACAAACACTCCTGGACACCTGCCCGGTTCTCAGGCTCCCTCCTTGGGGGCAAAGCTGCCCTG

ACCCTTTTGGGTGCGCAGCCTGAGGATGAGGCTGAGTATTACTGCTTGCTCTCCTATAGTGGTGCTCGG

IGLV9-49*01 nucleotide sequence
                                                        (SEQ ID NO: 1248)
CAGCCTGTGCTGACTCAGCCACCTTCTGCATCAGCCTCCCTGGGAGCCTCGGTCACACTCACCTGCACCCTGAGC

AGCGGCTACAGTAATTATAAAGTGGACTGGTACCAGCAGAGACCAGGGAAGGGCCCCCGGTTTGTGATGCGAGTG

GGCACTGGTGGGATTGTGGGATCCAAGGGGGATGGCATCCCTGATCGCTTCTCAGTCTTGGGCTCAGGCCTGAAT

CGGTACCTGACCATCAAGAACATCCAGGAAGAGGATGAGAGTGACTACCACTGTGGGGCAGACCATGGCAGTGGG

AGCAACTTCGTGTAACC

IGLV9-49*03 nucleotide sequence
                                                        (SEQ ID NO: 1249)
CAGCCTGTGCTGACTCAGCCACCTTCTGCATCAGCCTCCCTGGGAGCCTCGGTCACACTCACCTGCACCCTGAGC

AGCGGCTACAGTAATTATAAAGTGGACTGGTACCAGCAGAGACCAGGGAAGGGCCCCCGATTTGTGATGCGAGTG

GGCACTGGTGGGATTGTGGGATCCAAGGGGGATGGCATCCCTGATCGCTTCTCAGTCTTGGGCTCAGGCCTGAAT

CGGTACCTGACCATCAAGAACATCCAGGAAGAGGATGAGAGTGACTACCACTGTGGGGCAGACCATGGCAGTGGG

AGCAACTTCGTGTAACC
```

The heavy chain of an isolated monoclonal anti-hemagglutinin (HA) antibody (i.e., anti-hemagglutinin antibody of the invention) is derived from a germ line V (variable) gene such as, for example, the IGHV1, IGHV2, IGHV3, IGHV4, or IGHV5 germline gene or an allele thereof.

The HA antibodies of the invention include a variable heavy chain ($V_H$) region encoded by a human IGHV1, IGHV2, IGHV3, IGHV4, or IGHV5 germline gene sequence or an allele thereof. A IGHV1, IGHV2, IGHV3, IGHV4, or IGHV5 germline gene sequence is shown, e.g., in SEQ ID NOs: 457 to 485. The HA antibodies of the invention include a $V_H$ region that is encoded by a nucleic acid sequence that is at least 75% homologous to the IGHV1, IGHV2, IGHV3, IGHV4, or IGHV5 germline gene sequence or an allele thereof. Preferably, the nucleic acid sequence is at least 75%, 80%, 85%, 90%, 95%, 96%, 97% homologous to the IGHV1, IGHV2, IGHV3, IGHV4, or IGHV5 germline gene sequence or an allele thereof, and more preferably, at least 98%, 99% homologous to the IGHV1, IGHV2, IGHV3, IGHV4, or IGHV5 germline gene sequence or an allele thereof. The $V_H$ region of the HA antibody is at least 75% homologous to the amino acid sequence of the $V_H$ region encoded by the IGHV 1, IGHV2, IGHV3, IGHV4, or IGHV5 $V_H$ germline gene sequence or an allele thereof. Preferably, the amino acid sequence of $V_H$ region of the HA antibody is at least 75%, 80%, 85%, 90%, 95%, 96%, 97% homologous to the amino acid sequence encoded by the 75%, 80%, 85%, 90%, 95%, 96%, 97% germline gene sequence or an allele thereof, and more preferably, at least 98%, 99% homologous to the sequence encoded by the 75%, 80%, 85%, 90%, 95%, 96%, 97% germline gene sequence or an allele thereof.

The HA antibodies of the invention also include a variable light chain ($V_L$) region encoded by a human IGKV1, IGKV2, IGKV3, IGKV4, IGLV1, IGLV2, IGLV3, IGLV7, or IGLV9 germline gene sequence or an allele thereof. A human IGKV1, IGKV2, IGKV3, IGKV4, IGLV1, IGLV2, IGLV3, IGLV7, or IGLV9 $V_L$ germline gene sequence, or an allele thereof is shown, e.g., at SEQ ID NOs: 486 to 508. Alternatively, the HA antibodies include a IGKV1, IGKV2, IGKV3, IGKV4, IGLV1, IGLV2, IGLV3, IGLV7, or IGLV9 $V_L$ region that is encoded by a nucleic acid sequence that is at least 65% homologous to the IGKV1, IGKV2, IGKV3, IGKV4, IGLV1, IGLV2, IGLV3, IGLV7, or IGLV9 germline gene sequence or an allele thereof. Preferably, the nucleic acid sequence is at least 65%, 70%, 75%, 80%, 85%, 90%, 95%, 96%, 97% homologous to the IGKV1, IGKV2, IGKV3, IGKV4, IGLV1, IGLV2, IGLV3, IGLV7, or IGLV9 germline gene sequence or an allele thereof, and more preferably, at least 98%, 99% homologous to the IGKV1, IGKV2, IGKV3, IGKV4, IGLV1, IGLV2, IGLV3, IGLV7, or IGLV9 germline gene sequence or an allele thereof. The $V_L$ region of the HA antibody is at least 65% homologous to the amino acid sequence of the $V_L$ region encoded the IGKV1, IGKV2, IGKV3, IGKV4, IGLV1, IGLV2, IGLV3, IGLV7, or IGLV9 germline gene sequence or an allele thereof. Preferably, the amino acid sequence of $V_L$ region of the HA antibody is at least 65%, 70%, 75%, 80%, 85%, 90%, 95%, 96%, 97% homologous to the amino acid sequence encoded by the IGKV1, IGKV2, IGKV3, IGKV4, IGLV1, IGLV2, IGLV3, IGLV7, or IGLV9 germline gene sequence or an allele thereof, and more preferably, at least 98%, 99% homologous to the sequence encoded by the IGKV1, IGKV2, IGKV3, IGKV4, IGLV1, IGLV2, IGLV3, IGLV7, or IGLV9 germline gene sequence or an allele thereof.

HA Antibodies III

The present invention relates to an immunogen capable of inducing antibodies against a target peptide of the stem region of hemagglutinn protein of an influenza virus. The immunogen is a peptide or a synthetic peptide. In particular, the immunogen of this invention comprises one or more epitopes or epitope units. Optionally, the immunogen further comprises a general immune stimulator. These immunogens of the present invention are capable of inducing antibodies against influenza A virus to prevent infection by the virus.

In one aspect the invention provides an immunogen having an epitope or epitope unit recognized by a protective monoclonal antibody having the specificity for the stem region of hemagglutinn protein of an influenza virus.

The antibody binds both the HA1 and HA2 peptide. In some embodiments the epitope is recognized by monoclonal antibody D7, D8, F10, G17, H40, A66, D80, E88, E90, or H98 or a monoclonal antibody that competes with the binding of monoclonal antibody D7, D8, F10, G17, H40, A66, D80, E88, E90, or H98 to the HA protein. Preferably, the epitope is the F10 epitope.

In some embodiments the hemagglutinin protein is in the neutral pH conformation.

The immunogen is a peptide or a synthetic peptide.

In some aspects the immunogen is a conjugate having one or more peptides or peptide fragments that are spatially positioned relative to each other so that they together form a non-linear sequence which mimics the tertiary structure of an F10 epitope. Optionally, the one or more peptides or peptide fragments are linked to a backbone. The conjugate competes with the binding of monoclonal antibody F10 to the HA protein.

The e conformation of the epitope is defined by amino acid residues 18, 38, 39, 40 and 291 of HA1 and 18, 19, 20, 21, 38, 41, 42, 45, 49, 52, 53, and 56 of HA2 when the hemagglutinin in the neutral pH conformation.

In some embodiments the immunogen is a peptide having one or more of the following amino acid sequences.

$[Xaa_0]_m$-$Xaa_1$-$Xaa_2$-$[Xaa_0]_p$, wherein, preferably, $Xaa_1$ is S, T, F H or Y and Xaa 2 is H, Y, M, L or Q. Most preferably, $Xaa_1$ is Y. Most preferably, $Xaa_2$ is H.

$[Xaa_0]_m$-$Xaa_1$-$Xaa_2$-$[Xaa_0]_p$, wherein, preferably, $Xaa_1$ is H, Q, Y, S, D, N or T and $Xaa_2$ of is Q, E, K, I , V, M, E, R or T. Most preferably, $Xaa_1$ is H. Most preferably, $Xaa_2$ is Q.

$[Xaa_0]_m$-$Xaa_1$-$Xaa_2$-$Xaa_3$-$Xaa_4$-$[Xaa_0]_p$, wherein, preferably, $Xaa_1$ is I, V, M, or L; $Xaa_2$ is D, N, H, Y, D, A, S or E, $Xaa_3$ is G or A, and $Xaa_4$ is W, R, or G. Most preferably, $Xaa_1$ is V; $Xaa_2$ is D, $Xaa_3$ is G, and $Xaa_4$ is W.

$[Xaa_0]_m$-$Xaa_1$-$[Xaa_0]_q$ $Xaa_2$-$Xaa_3$-$[Xaa_0]_q$ $Xaa_4$-$[Xaa_0]_r$ $Xaa_5$-$[Xaa_0]_q$-$Xaa_6$ $Xaa_7$-$[Xaa_0]_q$-$Xaa_8$-$[Xaa_0]_p$, and $[Xaa_0]_m$- $Xaa_1$-$[Xaa_0]_q$ $Xaa_2$-$Xaa_3$-$[Xaa_0]_q$ $Xaa_4$-$[Xaa_0]_r$ $Xaa_5$-$[Xaa_0]_q$-$Xaa_6$ $Xaa_7$-$[Xaa_0]_s$-$[Xaa_8]_t$-$[Xaa_0]_p$, wherein, preferably $Xaa_1$ is K, Q, R, N, L, G, F, H or Y; $Xaa_2$ is S or T, $Xaa_3$ is Q or P; $Xaa_4$ is F, V, I, M, L, or T; $Xaa_5$ is I, T, S, N, Q, D, or A; $Xaa_6$ is I, V, M, or L; $Xaa_7$ is N, S, T, or D and $Xaa_8$ is I, F,V, A, or T. Most preferably, $Xaa_1$ is K; $Xaa_2$ is T, $Xaa_3$ is Q; $Xaa_4$ is I; $Xaa_5$ is T; $Xaa_6$ is V; $Xaa_7$ is N, and $Xaa_8$ is I.

For all of the preceding sequences, m, and p are independently 0 or 1-100, preferably about 1-90, 1-80, 1-70, 1-60, 1-50, 1-40, 1-30, 1-20 or 1-10; q is 2, r is 3, s is 0 or 2, and t is 0 or 1, and $Xaa_0$, is independently any amino acid. Preferably s is 2 and t is 1.

In some aspects of the inventions, one or more amino acids are D-amino acids.

Optionally, the immunogen further comprises an adjuvant or is conjugated to a carrier.

In various aspects the invention includes a composition containing the immunogen together with one or more pharmaceutically acceptable excipients, diluents, and/or adjuvants. In some embodiments the composition further comprises an anti-influenza antibody of antigen binding fragment thereof. Preferably, the antibody is monoclonal antibody D7, D8, F10, G17, H40, A66, D80, E88, E90, or H98 or a monoclonal antibody that competes with the binding of monoclonal antibody D7, D8, F10, G17, H40, A66, D80, E88, E90, or H98 to the HA protein. Also provided by the invention are nucleic acids encoding the immunogens of the invention and composition comprising the nucleic acids.

The invention further comprises a method preventing a disease or disorder caused by an influenza virus by administering to person at risk of suffering from said disease or disorder an immunogen composition described herein. Optionally, the method includes further administering an anti-viral drug, a viral entry inhibitor or a viral attachment inhibitor. The anti-viral drug is a neuraminidase inhibitor, a HA inhibitor, a sialic acid inhibitor or an M2 ion channel. The M2 ion channel inhibitor is amantadine or, rimantadine. The neuraminidase inhibitor zanamivir, or oseltamivir phosphate.

In another aspect the method includes further administering one or more antibodies specific to a Group I influenza virus and or a Group II influenza virus. The antibody is administered at a dose sufficient to neutralize the influenza virus.

Administration is prior to or after exposure to influenza virus.

Also disclosed are methods of treating subjects and methods of screening and producing antibodies. For example, disclosed is a method of treating a subject suffering or at risk of influenza infection, the method comprising administering to the subject one or more of the disclosed antibodies, such as the disclosed HA stem antibodies. For example, disclosed is a method of treating a subject, the method comprising administering to the subject the stem region of influenza hemagglutinin in the neutral pH conformation in isolation from other components of influenza virus, wherein the subject produces an immune response to the stem region. For example, disclosed is a method of treating a subject, the method comprising administering to the subject the stem region of influenza hemagglutinin in the neutral pH conformation in isolation from the head region of hemagglutinin, wherein the subject produces an immune response to the stem region. For example, disclosed is a method of treating a subject, the method comprising administering to the subject influenza hemagglutinin in the neutral pH conformation in isolation from other components of influenza virus, wherein the head region of the hemagglutinin is modified to reduce the antigenicity of the head region, wherein the subject produces an immune response to the stem region. For example, disclosed is a method, the method comprising screening antibodies reactive to hemagglutinin for binding to hemagglutinin immobilized on a surface, thereby identifying antibodies of interest. For example, disclosed is a method comprising screening antibodies reactive to hemagglutinin for binding to the stem region of influenza hemagglutinin in the neutral pH conformation in isolation from the head region of hemagglutinin, thereby identifying antibodies of interest. For example, disclosed is a method comprising screening antibodies reactive to hemagglutinin for binding to influenza hemagglutinin in the neutral pH conformation in isolation from other components of influenza virus, wherein the head region of the hemagglutinin is modified to reduce the antigenicity of the head region, thereby identifying antibodies of interest.

In some forms, the head region of the hemagglutinin can be modified by removing or replacing glycosylation sites. In some forms, the head region of the hemagglutinin can be modified by adding glycosylation sites. In some forms, the head region of the hemagglutinin can be modified by removing all or a portion of the head region.

In some forms, the disclosed antibodies, disclosed hemagglutinins, and disclosed methods can produce an immune reaction in a subject. For example, in some forms, the subject can produce an immune response that prevents or reduces the severity of an influenza infection. In some forms, the immune response can be reactive to influenza viruses within a subtype. In some forms, the immune response can be reactive to influenza viruses in each subtype within a cluster. In some forms, the immune response can be reactive to influenza viruses in each cluster within a group. In some forms, the immune response can be reactive to all influenza viruses in each subtype within a group. In some forms, the immune response can be reactive to influenza viruses within group 1.

In some forms, the disclosed methods can further comprise screening the antibodies of interest for competing with antibody F10 for binding to hemagglutinin, thereby identifying F10-competing antibodies. In some forms, the hemagglutinin can be hemagglutinin from a group 2 influenza virus. In some forms, the hemagglutinin can be hemagglutinin from a group 1 influenza virus. In some forms, the disclosed methods can further comprising producing the identified antibodies. Also disclosed are antibodies produced by the disclosed methods. Also disclosed are antibodies identified by the disclosed methods.

The disclosed compositions and methods are based upon the discovery of monoclonal antibodies which neutralize the influenza virus, e.g. influenza A virus. The influenza A virus is a Group I influenza A virus such as a H1 cluster influenza virus. The H1 cluster influenza virus is an H1a cluster or an H1b cluster. The monoclonal antibody is fully human. In some forms, the monoclonal antibody can be a bivalent antibody, a monovalent antibody, a single chain antibody or fragment thereof. Specifically, such monoclonal can bind to an epitope on the stem region of the hemagglutinin protein (HA), such as HA1 or HA2 polypeptide. The epitope can be non-linear.

The epitope can comprise both the HA1 and HA2. The epitope can be non-linear. In some forms the epitope can comprise the amino acid position 18, 38, 40, 291 of the Ha1 polypeptide and the amino acid at position 18, 19, 20, 21, 38, 41, 42, 45, 49, 52, 53 and 56 of the HA2 polypeptide.

The disclosed compositions and methods are further based upon the discovery of a protocol for generating broadly neutralizing human antibodies that target a highly conserved epitope in the stem region of HA. Using the trimeric H5 ectodomain expressed in baculovirus which produces shorter N-glycans and uncharged mannoses absorbed on a plastic surface, allowed for the dominant presentation of the stem epitope while masking the normally immunodominat globular head. Accordingly, also disclosed is a method of producing an isolated antibody that specifically binds a pathogenic enveloped virus by exposing a single chain or Fab expression library to a membrane fusion protein of the virus, identifying an antibody in the library that specifically binds said protein; and isolating the antibody from the library. The fusion protein can be immobilized on a solid surface, e.g. plastic. In some forms the fusion protein can have modified glycosylations compared to a wild type fusion protein. For example, the fusion can be produced in a non-mammalian cell, such as an insect cell. The fusion protein can be, for example, a trimeric hemagglutinin (HA) protein.

Also disclosed is a method of vaccinating a subject against pathogenic enveloped virus such as an influenza virus by administering to the subject, for example, a membrane fusion protein (e.g., a trimeric hemagglutinin (HA) protein coated) or embedded in a biologically compatible matrix. In some forms the fusion protein can have modified glycosylations compared to a wild type fusion protein.

Also disclosed is a composition comprising a monoclonal antibody as described herein and kits containing the composition in one or more containers and instructions for use. The invention further provides a method of screening a compound for binding to an F10 antibody by contacting said F10 antibody with a compound of interest and detecting a compound-antibody complex. Also included in the invention are the compound identified by the method and their use as immunogens.

High affinity, cross-subtype, broadly-neutralizing human anti-HA mAbs have been identified. Specifically, a human Ab phage display library and H5 hemagglutinin (HA) ectodomain was used to select ten neutralizing mAbs (nAbs) with a remarkably broad range among Group 1 influenza viruses, including the H5N1 "bird flu" and the H1N1 "Spanish flu" and "Swine flu" strains. These nAbs inhibit the post-attachment fusion process by recognizing a novel and highly conserved neutralizing epitope within the stem region at a point where key elements of the conformational change—the fusion peptide and the exposed surface of helix aA—are brought into close apposition. The crystal structure of one mAb (mAbFlO) bound to H5N1 HA reveals that only the heavy chain inserts into a highly conserved pocket in the HA stem region, inhibiting the conformational changes required for membrane fusion. It has been discovered that nAbs targeting this pocket can provide broad protection against both seasonal and pandemic influenza A infections. The crystal structure further revealed that the epitope to which the F10 mAb is defined by amino acid residues 18, 38, 39, 40 and 291 of HA1 and 18, 19, 20, 21, 38, 41, 42, 45, 49, 52, 53, and 56 of HA2. This epitope is referred to herein as the F10 epitope. Structural and sequence analysis of all 16 HA subtypes points to the existence of only two variants of this epitope, corresponding to the two phylogenetic groupings of HA (Groups 1 and 2). This discovery indicates that a small cocktail of nAbs derived from a subset of each group can provide broad protection against both seasonal and pandemic influenza.

Remarkably, nAbs were isolated that utilize the same VH germline gene, IGHV1-69*01, and encode a CDR3 loop containing a tyrosine at an equivalent position to Y102, from a non-immune library. This indicates that broad anti-HA cross-immunity pre-exists in the H5-naive population, possibly due to previous exposure to H1, and, for library donors born before 1968, H2 subtypes. The recurrent use of this germline VH segment, the commonality of the CDR3 tyrosine introduced through N insertion and/or germline D gene assembly, and the promiscuous use of VL genes by the discovered nAbs discovered indicate that the precursor frequency of rearranged VH segments that could recognize this epitope is significant. This indicates that with suitable exposure to the F10 epitope identified here, these broad-spectrum nAbs can be readily induced in vivo. These discoveries led to the disclosed simple solution to provide universal protection against virus subtypes in both groups.

Three unique anti-HA-1 scFvs were identified by sequencing analysis of the 58 HA-1 positive clones. These scFvs were designated as 38B and 1C. The VH and VL amino acid sequence of 2A is shown herein. Ten unique anti-HA0 scFvs were identified by sequencing analysis of the 97 HA0 positive clones. These scFvs were designated as 7, 8, 10, 17, 40, 66, 80, 88, 90, and 98. Six different VH and 10 different VL genes were revealed. Some scFvs shared the same VH gene. Five out of the six different VH genes belonged to the IGHV1-69 gene family. Three out of ten VL genes were kappa chain. 2A scFv is a moderate neutralizing antibody, 38B and 1C are non-neutralizing antibodies. Ten scFvs, 7, 8, 10, 17, 40, 66, 80, 88, 90, and 98 are potent neutralizing antibodies. The nucleic acid and amino acid sequence of the neutralizing influenza antibodies are provided below. Methods of making these antibodies are disclosed in PCT/US2009/054950 (Publication No. WO 2010/027818), the entire contents of which are incorporated herein by reference.

Antibody 2A: Variable Region Nucleic Acid Sequences

VH chain of 2A
(SEQ ID NO: 1305)
CAGGTGCAGCTGGTGCAGTCTGGGGCTGAGGTGAAGAAGCCTGGGTCCTC

GGTGAAGGTCTCCTGCAAGGCTTCTGGAGGCACCTTCAGTGACAATGCTA

TCAGCTGGGTGCGACAGGCCCCAGGACAAGGGCTTGAGTGGATGGGGGGC

ATCATTCCTATCTTTGGAAAACCAAACTACGCACAGAAGTTCCAGGGCAG

AGTCACGATTACTGCGGACGAATCCACGAGCACAGCCTACATGGACCTGA

GGAGCCTGAGATCTGAGGACACGGCCGTTTATTACTGTGCGAGAGATTCA

GACGCGTATTACTATGGTTCGGGGGGTATGGACGTCTGGGGCCAAGGCAC

CCTGGTCACCGTCTCCTCA

VL chain of 2A
(SEQ ID NO: 1306)
CTGCCTGTGCTGACTCAATCATCCTCTGCCTCTGCTTCCCTGGGATCCTC

GGTCAAGCTCACCTGCACTCTGAGCAGTGGGCATAGTAACTACATCATCG

CATGGCATCAACAGCAGCCAGGGAAGGCCCCTCGGTACTTGATGAAGGTT

AATAGTGATGGCAGCCACACCAAGGGGGACGGGATCCCTGATCGCTTCTC

AGGCTCCAGCTCTGGGGCTGACCGCTACCTCACCATCTCCAACCTCCAGT

CTGAGGATGAGGCTAGTTATTTCTGTGAGACCTGGGACACTAAGATTCAT

GTCTTCGGAACTGGGACCAAGGTCTCCGTCCTCAG

Antibody 2A: Variable Region Aamino Acid Sequences

VH chain of 2A
(SEQ ID NO: 1307)
QVQLVQSGAEVKKPGSSVKVSCKASGGTFSDNAISWVRQAPGQGLEWMGG

IIPIFGKPNYAQKFQGRVTITADESTSTAYMDLRSLRSEDTAVYYCARDS

DAYYYGSGGMDVWGQGTLVTVSS

VL chain of 2A
(SEQ ID NO: 1308)
LPVLTQSSSASASLGSSVKLTCTLSSGHSNYIIAWHQQQPGKAPRYLMKV

NSDGSHTKGDGIPDRFSGSSSGADRYLT ISNLQSEDEASYFCETWDTK

I HVFGTGTKVSVL

Antibody D7: Variable Region Nucleic Acid Sequences

VH chain of D7
(SEQ ID NO: 1309)
CAGGTGCAGCTGGTGCAGTCTGGGGCTGAGGTGAAGAAGCCTGGGTCCTC

GGTGAAGGTCTCCTGCAAGGCTCCTGGAGGTATCTTCAACACCAATGCTT

TCAGCTGGGTCCGACAGGCCCCTGGACAAGGTCTTGAGTGGGTGGGAGGG

GTCATCCCTTTGTTTCGAACAGCAAGCTACGCACAGAACGTCCAGGGCAG

AGTCACCATTACCGCGGACGAATCCACGAACACAGCCTACATGGAGCTTA

CCAGCCTGAGATCTGCGGACACGGCCGTGTATTACTGTGCGAGAAGTAGT

GGTTACCATTTTAGGAGTCACTTTGACTCCTGGGGCCTGGGAACCCTGGT

CACCGTCTCCTCA

VL chain of D7
(SEQ ID NO: 1310)
AATTTTATGCTGACTCAGCCCCACTCTGTGTCGGCGTCTCCGGGGAAGAC

GGTGACCATCTCCTGCACCGGCAGCAGTGGCAACATTGCCGCCAACTATG

TGCAGTGGTACCAACAACGTCCGGGCAGTGCCCCCACTACTGTGATCTAT

GAGGATGACCGAAGACCCTCTGGGGTCCCTGATCGGTTCTCTGGCTCCAT

CGACAGGTCCTCCAACTCTGCCTCCCTCACCATCTCAGGACTGAAGACTG

AGGACGAGGCTGACTACTACTGTCAGACTTATGATACCAACAATCATGCT

GTGTTCGGAGGAGGCACCCACCTGACCGTCCTC

Antibody H98: Variable Region Nucleic Acid Sequences

VH chain of H98
(SEQ ID NO: 1311)
CAGGTGCAGCTGGTGCAATCTGGGGCTGAGGTGAAGAAGCCTGGGTCCTC

GGTGAAGGTCTCCTGCAAGGCTCCTGGAGGTATCTTCAACACCAATGCTT

TCAGCTGGGTCCGACAGGCCCCTGGACAAGGTCTTGAGTGGGTGGGAGGG

GTCATCCCTTTGTTTCGAACAGCAAGCTACGCACAGAACGTCCAGGGCAG

AGTCACCATTACCGCGGACGAATCCACGAACACAGCCTACATGGAGCTTA

CCAGCCTGAGATCTGCGGACACGGCCGTGTATTACTGTGCGAGAAGTAGT

GGTTACCATTTTAGGAGTCACTTTGACTCCTGGGGCCTGGGAACCCTGGT

CACCGTCTCCTCA

VL chain of H98
(SEQ ID NO: 1312)
TCCTATGAGCTGACTCAGCCACCCTCAGCGTCTGGGAAACACGGGCAGAG

GGTCACCATCTCTTGTTCTGGAGGCACCTCCAACATCGGACGTAATCATG

TTAACTGGTACCAGCAACTCCCAGGAACGGCCCCCAAACTCCTCATCTAT

AGTAATGAACAGCGGCCCTCAGGGGTCCCTGACCGATTCTCTGGCTCCAA

ATCTGGCACCTCCGCCTCCCTGGCCGTGAGTGGGCTCCAGTCTGAGGATG

AGGCTGATTATTACTGTGCATCATGGGATGACAACTTGAGTGGTTGGGTG

TTCGGCGGAGGGACCAAGCTGACCGTCCTA

Antibody D7 and H98: Variable Region Chain Amino Acid Sequences

VH chain of D7 and H98
(SEQ ID NO: 1313)
QVQLVQSGAEVKKPGSSVKVSCKAPGGIFNTNAFSWVRQAPGQGLEWVGG
VIPLFRTASYAQNVQGRVT I TADESTNTAYMELTSLRSADTAVYYCAR
SSGYH FRSHFDSWGLGTLVTVSS VL chain of D7
(SEQ ID NO: 1314)
NFMLTQPHSVSASPGKTVTISCTGSSGNIAANYVQWYQQRPGSAPTTVIY
EDDRRPSGVPDRFSGSIDRSSNSASLTISGLKTEDEADYYCQTYDTNNHA
VFGGGTHLTVL VL chain of H98
(SEQ ID NO: 1315)
SYELTQPPSASGKHGQRVTISCSGGTSNIGRNHVNWYQQLPGTAPKLLIY
SNEQRPSGVPDRFSGSKSGTSASLAVSGLQSEDEADYYCASWDDNLSGWV
FGGGTKLTVL

Antibody D8: Variable Region Nucleic Acid Sequences

VH chain of D8
(SEQ ID NO: 1316)
CAGGTGCAGCTGGTGCAGTCTGGGGCTGAGGTGAAGAAGCCTGGGTCCTC
GGTGAAGGTCTCCTGCAAGGCTTCTGGAGGCACCTTCAGCGCTTATGCTT
TCACCTGGGTGCGGCAGGCCCCTGGACAAGGGCTTGAGTGGATGGGAGGC
ATCACCGGAATGTTTGGCACAGCAAACTACGCACAGAAGTTCCAGGGCAG
AGTCACGATTACCGCGGACGAACTCACGAGCACAGCCTACATGGAGTTGA
GCTCCCTGACATCTGAAGACACGGCCCTTTATTATTGTGCGAGAGGATTG
TATTACTATGAGAGTAGTCTTGACTATTGGGGCCAGGGAACCCTGGTCAC
CGTCTCCTCAG VL chain of D8
(SEQ ID NO: 1317)
CAGTCTGTGCTGACTCAGCCACCCTCCGCGTCCGGGTCTCCTGGACAGTC
AGTCACCATCTCCTGCACTGGAACCAGCAGTGACGTTGGTGGTTATAACT
CTGTCTCCTGGTACCAACAGCACCCAGGCAAAGCCCCCAAACTCATGATT
TATGAGGTCACTAAGCGGCCCTCAGGGGTCCCTGATCGCTTCTCTGCCTC
CAAGTCTGGCAACACGGCCTCCCTGACCGTCTCTGGGCTCCAGGCTGAGG
ATGAGGCTGATTATTTCTGCTGCTCATATGCAGGCCACAGTGCTTATGTC
TTCGGAACTGGGACCAAGGTCACCGTCCTG

Antibody D80: Variable Region Nucleic Acid Sequences

VH chain of D80
(SEQ ID NO: 1318)
CAGGTGCAGCTGGTGCAGTCTGGGGCTGAGGTGAAGAAGCCTGGGTCCTC
GGTGAAGGTCTCCTGCAGGGCTTCTGGAGGCACCTTCAGCGCTTATGCTT
TCACCTGGGTGCGGCAGGCCCCTGGACAAGGGCTTGAGTGGATGGGAGGC
ATCACCGGAATGTTTGGCACAGCAAACTACGCACAGAAGTTCCAGGGCAG
AGTCACGATTACCGCGGACGAACTCACGAGCACAGCCTACATGGAGTTGA
GCTCCCTGACATCTGAAGACACGGCCCTTTATTATTGTGCGAGAGGATTG
TATTACTATGAGAGTAGTCTTGACTATTGGGGCCAGGGAACCCTGGTCAC
CGTCTCCTCAG VK chain of D80
(SEQ ID NO: 1319)
GAAATTGTGCTGACTCAGTCTCCAGGCACCCTGTCTTTGTCTCCAGGGGA
AAGAGCCACCCTCTCCTGCAGGGCCAGTCAGAGTCTTAGCAGCAAGTACT
TAGCCTGGTATCAGCAGAAACCTGGCCAGGCTCCCAGGCTCCTCATCTAT
GGTGCATCCAGCAGGGCCACTGGCATCCCAGACAGGTTCAGTGGCAGTGG
GTCTGGGACAGACTTCACCCTCACCATCAGTAGACTGGAGCCTGAAGATT
TTGCAGTGTATTCCTGTCAGCAGTATGATGGCGTACCTCGGACGTTCGGC
CAAGGGACCACGGTGGAAATCAAA

Antibody D8 and D80: Variable Region Chain Amino Acid Sequences

VH chain of D8 and D80
(SEQ ID NO: 1320)
QVQLVQSGAEVKKPGSSVKVSCKASGGTFSAYAFTWVRQAPGQGLEWMGG
ITGMFGTANYAQKFQGRVTITADELTSTAYMELSSLTSEDTALY VL chain of D8
(SEQ ID NO: 1321)
YCARGLYYYESSLDYWGQGTLVTVSSQSVLTQPPSASGSPGQSVTISCTG
TSSDVGGYNSVSWYQQHPGKAPKLMIYEVTKRPSGVPDRFSASKSGNTAS
LTVSGLQAEDEADYFCCSYAGHSAYVFGTGTKVTVL VK chain of D80
(SEQ ID NO: 1322)
EIVLTQSPGTLSLSPGERATLSCRASQSLSSKYLAWYQQKPGQAPRLLIY
GASSRATGIPDRFSGSGSGTDFTLTISRLEPEDFAVYSCQQYDGVPRTFG
QGTTVEIK

Antibody F10: Variable Region Nucleic Acid Sequences

VH chain of F10
(SEQ ID NO: 1323)
CAGGTGCAGCTGGTGCAGTCAGGGGCTGAGGTGAAGAAGCCTGGGTCCTC
GGTGAAGGTCTCCTGCACGTCCTCTAAGTCACCTTCAGTAGTTTTGGCTA
TCAGCTGGGTGCGACAGGCCCCTGGACAAGGGCTTGAGTGGCTGGGAGGG
ATCAGCCCTATGTTTGGAACACCTAATTACGCGCAGAAGTTCCAAGGCAG
AGTCACCATTACCGCGGACCAGTCCACGAGGACAGCCTACATGGACCTGA
GGAGCCTGAGATCTGAGGACACGGCCGTGTATTATTGTGCGAGATCTCCT
TCTTACATTTGTTCTGGTGGAACCTGCGTCTTTGACCATTGGGGCCAGGG
AACCCTGGTCACCGTCTCCTCA VL chain of F10
(SEQ ID NO: 1324)
CAGCCTGGGCTGACTCAGCCACCCTCGGTGTCCAAGGGCTTGAGACAGAC
CGCCACACTCACCTGCACTGGGAACAGCAACAATGTTGGCAACCAAGGAG
CAGCTTGGCTGCAGCAGCACCAGGGCCACCCTCCCAAACTCCTATCCTAC
AGGAATAATGACCGGCCCTCAGGGATCTCAGAGAGATTCTCTGCATCCAG

```
GTCAGGAAACACAGCCTCCCTGACCATTACTGGACTCCAGCCTGAGGACG

AGGCTGACTATTACTGCTCAACATGGGACAGCAGCCTCAGTGCTGTGGTA

TTCGGCGGAGGGACCAAGCTGACCGTCCTA
```

Antibody E90: Variable Region Nucleic Acid Sequences

```
VH chain of E90
                                        (SEQ ID NO: 1325)
CAGGTACAGCTGCAGCAGTCAGGGGCTGAGGTGAAGAAGCCTGGGTCCTC

GGTGAAGGTCTCCTGCACGTCCTCTGAAGTCACCTTCAGTAGTTTTGCTA

TCAGCTGGGTGCGACAGGCCCCTGGACAAGGGCTTGAGTGGCTGGGAGGG

ATCAGCCCTATGTTTGGAACACCTAATTACGCGCAGAAGTTCCAAGGCAG

AGTCACCATTACCGCGGACCAGTCCACGAGGACAGCCTACATGGACCTGA

GGAGCCTGAGATCTGAGGACACGGCCGTGTATTATTGTGCGAGATCTCCT

TCTTACATTTGTTCTGGTGGAACCTGCGTCTTTGACCATTGGGGCCAGGG

AACCCTGGTCACCGTCTCCTCA

VL chain of E90
                                        (SEQ ID NO: 1326)
GACATCCAGATGACCCAGTCTCCATCCTCCCTGTCTGCATCTGTAGGAGA

CAGAGTCACCATCACTTGCCGGGCAAGTCAGAGCATTAGCAGCTATTTAA

ATTGGTATCAGCAGAAACCAGGGAAAGCCCCTAAGCTCCTGATCTATGCT

GCATCCAGTTTGCAAAGAGGGGTCCCATCAAGGTTCAGTGGCAGTGGATC

TGGGACAGACTTCACTCTCACCATTAGCAGCCTGCAGCCTGAAGATTTTG

CAGTGTATTACTGTCAGCAGTATGATAGTTCACCGTACACTTTTGGCCAG

GGGACCAAGGTAGAGATCAAA
```

Antibody F10 and E90 Variable Region Amino Acid Sequences

```
VH chain of F10 and E90
                                        (SEQ ID NO: 1327)
QVQLVQSGAEVKKPGS SVKVSCTSSEVTFSSFAISWVRQAPGQGLEWLG

GISPMFGTPNYAQKFQGRVTITADQSTRTAYMDLRSLRSEDTAVYYCARS

PSYICSGGTCVFDHWGQGTLVTVSS

VL chain of F10
                                        (SEQ ID NO: 1328)
QPGLTQPPSVSKGLRQTATLTCTGNSNNVGNQGAAWLQQHQGHPPKLLSY

RNNDRPSGISERFSASRSGNTASLTITGLQPEDEADYYCSTWDSSLSAVV

FGGGTKLTVL

VL chain of E90
                                        (SEQ ID NO: 1329)
DIQMTQSPSSLSASVGDRVTITCRASQSISSYLNWYQQKPGKAPKLLIYA

ASSLQRGVPSRFSGSGSGTDFTLTISSLQPEDFAVYYCQQYDSSPYTFGQ

GTKVEIK
```

Antibody G17: Variable Region Nucleic Acid Sequences

```
VH chain of G17
                                        (SEQ ID NO: 1330)
CAGGTGCAGCTGGTGCAATCTGGGGCTGAAGTGAAGAAGCCTGGGGCCTC

AGTGAAGGTCTCCTGCAAGACTTCTGGAGTCACCTTCAGCAGCTATGCTA

TCAGTTGGGTGCGACAGGCCCCTGGACAAGGGCTTGAGTGGATGGGAGGG

ATCATCGGTGTCTTTGGTGTACCAAAGTACGCGCAGAACTTCCAGGGCAG

AGTCACAATTACCGCGGACAAACCGACGAGTACAGTCTACATGGAGCTGA

ACAGCCTGAGAGCTGAGGACACGGCCGTGTATTACTGTGCGAGAGAGCCC

GGGTACTACGTAGGAAAGAATGGTTTTGATGTCTGGGGCCAAGGGACAAT

GGTCACCGTCTCTTCA

VL chain of G17
                                        (SEQ ID NO: 1331)
TCCTATGAGCTGACTCAGCCACCCTCGGTGTCCAAGGGCTTGAGACAGAC

CGCCATACTCACCTGCACTGGAGACAGCAACAATGTTGGCCACCAAGGTA

CAGCTTGGCTGCAACAACACCAGGGCCACCCTCCCAAACTCCTATCCTAC

AGGAATGGCAACCGGCCCTCAGGGATCTCAGAGAGATTCTCTGCATCCAG

GTCAGGAAATACAGCCTCCCTGACCATTATTGGACTCCAGCCTGAGGACG

AGGCTGACTACTACTGCTCAGTATGGGACAGCAGCCTCAGTGCCTGGGTG

TTCGGCGGAGGGACCAAGCTGACCGTCCTA
```

Antibody G17 Variable Region Amino Acid Sequences

```
VH chain of G17
                                        (SEQ ID NO: 1332)
QVQLVQSGAEVKKPGASVKVSCKTSGVTFSSYAISWVRQAPGQGLEWMGG

IIGVFGVPKYAQNFQGRVTITADKPTSTVYMELNSLRAEDTAVYYCAREP

GYYVGKNGFDVWGQGTMVTVSS

VL chain of G17
                                        (SEQ ID NO: 1333)
SYELTQPPSVSKGLRQTAILTCTGDSNNVGHQGTAWLQQHQGHPPKLLSY

RNGNRPSGISERFSASRSGNTASLTIIGLQPEDEADYYCSVWDSSLSAWV

FGGGTKLTVL
```

Antibody H40: Variable Region Nucleic Acid Sequences

```
VH chain of H40
                                        (SEQ ID NO: 1334)
CAGGTGCAGCTGGTGCAGTCTGGGGCTGAGGTGAGGAAGCCTGGGGCCTC

AGTGAAGGTCTCATGTAAGGCTTCTGGATACACCTTCACCGGTTATTATA

TTCACTGGGTGCGACAGGCCCCTGGACAAGGACTTGAGTGGATGGGTTGG

ATCAACCCTATGACTGGTGGCACAAACTATGCACAGAAGTTTCAGGTCTG

GGTCACCATGACCCGGGACACGTCCATCAACACAGCCTACATGGAGGTGA

GCAGGCTGACATCTGACGACACGGCCGTGTATTACTGTGCGAGGGGGCT

TCCGTATTACGATATTTTGACTGGCAGCCCGAGGCTCTTGATATCTGGGG

CCTCGGGACCACGGTCACCGTCTCCTCA

VL chain of H40
```

```
                                             (SEQ ID NO: 1335)
CAGCCTGTGCTGACTCAGCCACCCTCGGTGTCAGTGGCCCCAGGACAGAC

GGCCAGCATTCCCTGTGGGGGGAACAACATTGGAGGCTACAGTGTACACT

GGTACCAACAAAAGCCGGGCCAGGCCCCCCTCTTGGTCATTTATGACGAT

AAAGACCGGCCCTCAGGGATCCCTGAGCGATTCTCTGGCGCCAACTCTGG

GAGCACGGCCACCCTGACAATCAGCAGGGTCGAAGCCGGGGATGAGGGCG

ACTACTACTGTCAGGTGTGGGATAGTGGTAATGATCGTCCGCTGTTCGGC

GGAGGGACCAAGCTGACCGTCCTA
```

Antibody H40: Variable Region Amino Acid Sequences

```
VH chain of H40
                                             (SEQ ID NO: 1336)
QVQLVQSGAEVRKPGASVKVSCKASGYTFTGYYIHWVRQAPGQGLEWMGW

INPMTGGTNYAQKFQVWVTMTRDTSINTAYMEVSRLTSDDTAVYYCARGA

SVLRYFDWQPEALDIWGLGTTVTVSS

VL chain of H40
                                             (SEQ ID NO: 1337)
QPVLTQPPSVSVAPGQTASIPCGGNNIGGYSVHWYQQKPGQAPLLVIYDD

KDRPSGIPERFSGANSGSTATLTISRVEAGDEGDYYCQVWDSGNDRPLFG

GGTKLTVL
```

Antibody A66 Variable Region Nucleic Acid Sequences

```
VH chain of A66
                                             (SEQ ID NO: 1338)
CAGGTGCAGCTGGTGCAGTCTGGGGCTGAAGTGAAGAAGCCTGGCTCCTC

GGTGAAGGTTTCCTGCAAGGCTTCTGGAGGCCCCTTCAGCATGACTGCTT

TCACCTGGCTGCGACAGGCCCCTGGACAAGGGCTTGAGTGGATGGGTGGG

ATCAGCCCTATCTTTCGTACACCGAAGTACGCACAGAAGTTCCAGGGCAG

AGTCACGATTACCGCGGACGAATCCACGAACACAGCCAACATGGAGCTGA

CCAGCCTGAAATCTGAGGACACGGCCGTGTATTACTGTGCGAGAACCCTT

TCCTCCTACCAACCGAATAATGATGCTTTTGCTATCTGGGGCCAAGGGAC

AATGGTCACCGTCTCTTCA

VK chain of A66
                                             (SEQ ID NO: 1339)
GAAATTGTGTTGACGCAGTCTCCAGCCACCCTGTCTTTGTCTCCAGGGGA

AAGAGCCACCCTCTCCTGCAGGGCCAGTCAGAGTGTTAGCAGCTACTTAG

CCTGGTACCAACAGAAACCTGGCCAGGCTCCCAGGCTCCTCATCTATGAT

GCATCCAACAGGGCCACTGGCATCCCAGCCAGGTTCAGTGGCAGTGGGTC

TGGGACAGACTTCACTCTCACCATCAGCAGACTGGAGCCTGAAGATTTTG

CAGTCTATTTCTGTCAGCAGTATGGTAGCTCACCTCAATTCGGCCAAGGG

ACACGACTGGAGATTAAA
```

Antibody A66 Variable Region Amino Acid Sequences

```
VH chain of A66
                                             (SEQ ID NO: 1340)
QVQLVQSGAEVKKPGSSVKVSCKASGGPFSMTAFTWLRQAPGQGLEWMGG

ISPIFRTPKYAQKFQGRVTITADESTNTANMELTSLKSEDTAVYYCARTL

VK chain of A66
                                             (SEQ ID NO: 1341)
SSYQPNNDAFAIWGQGTMVTVSSEIVLTQSPATLSLSPGERATLSCRASQ

SVSSYLAWYQQKPGQAPRLLIYDASNRATGIPARFSGSGSGTDFTLT I

SRLEPEDFAVYFCQQYGSSPQFGQGTRLEIK
```

Antibody E88 Variable Region Nucleic Acid Sequences

```
VH chain of E88
                                             (SEQ ID NO: 1342)
CAGGTGCAGCTGGTGCAGTCTGGGGCTGAAGTGAAGAAGCCTGGCTCCTC

GGTGAAGGTTTCCTGCAAGGCTTCTGGAGGCCCCTTCAGCATGACTGCTT

TCACCTGGCTGCGACAGGCCCCTGGACAAGGGCTTGAGTGGATGGGTGGG

ATCAGCCCTATCTTTCGTACACCGAAGTACGCACAGAAGTTCCAGGGCAG

AGTCACGATTACCGCGGACGAATCCACGAACACAGCCAACATGGAGCTGA

CCAGCCTGAAATCTGAGGACACGGCCGTGTATTACTGTGCGAGAACCCTT

TCCTCCTACCAACCGAATAATGATGCTTTTGCTATCTGGGGCCAAGGGAC

AATGGTCACCGTCTCTTCA

VL chain of E88
                                             (SEQ ID NO: 1343)
CTGCCTGTGCTGACTCAGCCACCCTCAGCGTCTGGGACCCCCGGGCAGAG

GGTCACCATCTCTTGTTCTGGAAGCAGCTCCAACATCGGAAGTAATACTG

TAAACTGGTACCAGCAGCTCCCAGGAACGGCCCCCAAACTCCTCATCTAT

AGTAATAATCAGCGGCCCTCAGGGGTCCCTGACCGATTCTCTGGCTCCAG

GTCAGGCACCTCAGCCTCCCTGGCCATCATTGGACTCCGGCCTGAGGATG

AAGCTGATTATTACTGTCAGTCGTATGACAGCAGGCTCAGTGCTTCTCTC

TTCGGAACTGGGACCACGGTCACCGTCCTC
```

Antibody E88 Variable Region Amino Acid Sequences

```
VH chain of E88
                                             (SEQ ID NO: 1344)
QVQLVQSGAEVKKPGSSVKVSCKASGGPFSMTAFTWLRQAPGQGLEWMGG

ISPIFRTPKYAQKFQGRVTITADESTNTANMELTSLKSEDTAVYYCARTL

SSYQPNNDAFAIWGQGTMVTVSS

VL chain of E88
                                             (SEQ ID NO: 1345)
LPVLTQPPSASGTPGQRVTISCSGSSSNIGSNTVNWYQQLPGTAPKLLIY

SNNQRPSGVPDRFSGSRSGTSASLAIIGLRPEDEADYYCQSYDSRLSASL

FGTGTTVTVL
```

The amino acid sequences of the heavy and light chain complementary determining regions of the neutralizing influenza antibodies are shown below in Table 18.

TABLE 18

| ANTIBODY | CHAIN | CDR1 | SEQ ID NO: | CDR2 | SEQ ID NO: | CDR3 | SEQ ID NO: |
|---|---|---|---|---|---|---|---|
| CONSENSUS | HEAVY | SYAFS | | GIIPMFGTPNYAQKFQG | 299 | SSGYYYGGGFDV | 1263 1284 |
| D7/H98 | HEAVY | TNAFS | | GVIPLFRTASYAQNVQN | 302 | SSGYHFGRSHFDS | 1264 1285 |
| D8/D80 | HEAVY | AYAFT | | GITGMFGTANYAQKFQG | 305 | GLYYYESSLDY | 1265 1286 |
| F10/E90 | HEAVY | SFAIS | | GISPMFGTPNYAQKFQG | 600 | SPSYICSGGTCVFDH | 1266 1287 |
| G17 | HEAVY | SYAIS | | GIIGVFGVPKYAQKFQG | 606 | EPGYYGKNGFDV | 1267 1288 |
| H40 | HEAVY | GYYIH | | WINPMTGGTNYAQKFQV | 630 | GASVLRYFDWQPEALDI | 1268 1289 |
| A66 | HEAVY | MTAFT | | GISPIFRTPKYAQKFQG | 641 | TLSSYQPNNDAFAI | 1269 1290 |
| E88 | HEAVY | MTAFT | | GISPIFRTPKYAQKFQG | 647 | TLSSYQPNNDAFAI | 1270 1291 |
| 2A | HEAVY | DNAIS | | GIIPIFGKPNYAQKFQG | 668 | DSDAYYYGSGGMDV | 1271 1292 |
| CONSENSUS | LIGHT | TGSSSMNIGNYVA | | SNSDRPS | 757 | QSYDSLSAYV | 1272 1293 |
| D7 | LIGHT | TGSSSNIAANYVQ | | EDDRRPS | 1252 | QTYDTNNHAV | 1273 1294 |
| D8 | LIGHT | TGTSSDVGGYNSVS | | EVTKRPS | 1253 | CSYAGHSAYV | 1274 1295 |
| F10 | LIGHT | TGNSNNVGNQGAA | | RNNDRPS | 1254 | STWDSSLSAVV | 1275 1296 |
| G17 | LIGHT | TGNSNNVGHQGTA | | RNGNRPS | 1255 | SVWDSSLSAWV | 1276 1297 |
| H40 | LIGHT | GGNNIGGYSVH | | DDKDRPS | 1256 | QVWDSGNDRPL | 1277 1298 |
| A66 | LIGHT | RASQSVSSYLA | | DASNRAT | 1257 | QQYGSSPQF | 1278 1299 |
| D80 | LIGHT | RASQSLSSKYLA | | GASSRAT | 1258 | QQYDGVPRT | 1279 1300 |
| E88 | LIGHT | SGSSSNIGSNTVN | | SNNQRPS | 1259 | QSYDSRLSASL | 1280 1301 |
| E90 | LIGHT | RASQSISSYLN | | AASSLQR | 1260 | QQYDSSPYT | 1281 1302 |
| H98 | LIGHT | SGGTSNIGRNHVN | | SNEQRPS | 1261 | ASWDDNLSGWV | 1282 1303 |
| 2A | LIGHT | TLSSGHSNYIIA | | VNSDGSHTKGD | 1262 | ETWDTKIHV | 1283 1304 |

Antibodies

Unless otherwise defined, scientific and technical terms used in connection with the present invention shall have the meanings that are commonly understood by those of ordinary skill in the art. Further, unless otherwise required by context, singular terms shall include pluralities and plural terms shall include the singular. Generally, nomenclatures utilized in connection with, and techniques of, cell and tissue culture, molecular biology, and protein and oligo- or polynucleotide chemistry and hybridization described herein are those well known and commonly used in the art. Standard techniques are used for recombinant DNA, oligonucleotide synthesis, and tissue culture and transformation (e.g., electroporation, lipofection). Enzymatic reactions and purification techniques are performed according to manufacturer's specifications or as commonly accomplished in the art or as described herein. The practice of the present invention will employ, unless indicated specifically to the contrary, conventional methods of virology, immunology, microbiology, molecular biology and recombinant DNA techniques within the skill of the art, many of which are described below for the purpose of illustration. Such techniques are explained fully in the literature. See, e.g., Sambrook, et al. Molecular Cloning: A Laboratory Manual (2nd Edition, 1989); Maniatis et al. Molecular Cloning: A Laboratory Manual (1982); DNA Cloning: A Practical Approach, vol. I & II (D. Glover, ed.); Oligonucleotide Synthesis (N. Gait, ed., 1984); Nucleic Acid Hybridization (B. Hames & S. Higgins, eds., 1985); Transcription and Translation (B. Hames & S. Higgins, eds., 1984); Animal Cell Culture (R. Freshney, ed., 1986); Perbal, A Practical Guide to Molecular Cloning (1984).

The nomenclatures utilized in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

The following definitions are useful in understanding the present invention:

The term "antibody" (Ab) as used herein includes monoclonal antibodies, polyclonal antibodies, multispecific antibodies (e.g., bispecific antibodies), and antibody fragments, so long as they exhibit the desired biological activity. The term "immunoglobulin" (Ig) is used interchangeably with "antibody" herein.

An "isolated antibody" is one that has been separated and/or recovered from a component of its natural environment. Contaminant components of its natural environment are materials that would interfere with diagnostic or therapeutic uses for the antibody, and may include enzymes, hormones, and other proteinaceous or nonproteinaceous solutes. In preferred embodiments, the antibody is purified: (1) to greater than 95% by weight of antibody as determined by the Lowry method, and most preferably more than 99% by weight; (2) to a degree sufficient to obtain at least 15 residues of N-terminal or internal amino acid sequence by use of a spinning cup sequenator; or (3) to homogeneity by SDS-PAGE under reducing or non-reducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The basic four-chain antibody unit is a heterotetrameric glycoprotein composed of two identical light (L) chains and two identical heavy (H) chains. An IgM antibody consists of 5 of the basic heterotetramer unit along with an additional polypeptide called J chain, and therefore contain 10 antigen binding sites, while secreted IgA antibodies can polymerize to form polyvalent assemblages comprising 2-5 of the basic 4-chain units along with J chain. In the case of IgGs, the 4-chain unit is generally about 150,000 daltons. Each L chain is linked to an H chain by one covalent disulfide bond, while the two H chains are linked to each other by one or more disulfide bonds depending on the H chain isotype. Each H and L chain also has regularly spaced intrachain disulfide bridges. Each H chain has at the N-terminus, a variable domain ($V_H$) followed by three constant domains ($C_H$) for each of the α and γ chains and four $C_H$ domains for μ and ε isotypes. Each L chain has at the N-terminus, a variable domain ($V_L$) followed by a constant domain ($C_L$) at its other end. The $V_L$ is aligned with the $V_H$ and the $C_L$ is aligned with the first constant domain of the heavy chain ($C_H1$). Particular amino acid residues are believed to form an interface between the light chain and heavy chain variable domains. The pairing of a $V_H$ and $V_L$ together forms a single antigen-binding site. For the structure and properties of the different classes of antibodies, see, e.g., Basic and Clinical Immunology, 8th edition, Daniel P. Stites, Abba I. Terr and Tristram G. Parslow (eds.), Appleton & Lange, Norwalk, Conn., 1994, page 71, and Chapter 6.

The L chain from any vertebrate species can be assigned to one of two clearly distinct types, called kappa (κ) and lambda (λ), based on the amino acid sequences of their constant domains ($C_L$). Depending on the amino acid sequence of the constant domain of their heavy chains ($C_H$), immunoglobulins can be assigned to different classes or isotypes. There are five classes of immunoglobulins: IgA, IgD, IgE, IgG, and IgM, having heavy chains designated alpha (α), delta (δ), epsilon (ε), gamma (γ) and mu (ξ), respectively. The γ and α classes are further divided into subclasses on the basis of relatively minor differences in $C_H$ sequence and function, e.g., humans express the following subclasses: IgG1, IgG2, IgG3, IgG4, IgA1, and IgA2.

The term "variable" refers to the fact that certain segments of the V domains differ extensively in sequence among antibodies. The V domain mediates antigen binding and defines specificity of a particular antibody for its particular antigen. However, the variability is not evenly distributed across the 110-amino acid span of the variable domains. Instead, the V regions consist of relatively invariant stretches called framework regions (FRs) of 15-30 amino acids separated by shorter regions of extreme variability called "hypervariable regions" that are each 9-12 amino acids long. The variable domains of native heavy and light chains each comprise four FRs, largely adopting a n-sheet configuration, connected by three hypervariable regions, which form loops connecting, and in some cases forming part of, the β-sheet structure. The hypervariable regions in each chain are held together in close proximity by the FRs and, with the hypervariable regions from the other chain, contribute to the formation of the antigen-binding site of antibodies (see Kabat et al., Sequences of Proteins of Immunological Interest, 5th Ed. Public Health Service, National Institutes of Health, Bethesda, Md. (1991)). The constant domains are not involved directly in binding an antibody to an antigen, but exhibit various effector functions, such as participation of the antibody in antibody dependent cellular cytotoxicity (ADCC).

The term "hypervariable region" when used herein refers to the amino acid residues of an antibody that are responsible for antigen binding. The hypervariable region generally comprises amino acid,residues from a "complemeniarity determining region" or "CDR" (e.g., around about residues 24-34 (L1), 50-56 (L2) and 89-97 (L3) in the $V_L$, and around about 31-35 (H1), 50-65 (H2) and 95-102 (H3) in the $V_H$ when numbered in accordance with the Kabat numbering system; Kabat et al., Sequences of Proteins of Immunological Interest, 5th Ed. Public Health Service, National Institutes of Health, Bethesda, Md. (1991)); and/or those residues from a "hypervariable loop" (e.g., residues 24-34 (L1), 50-56 (L2) and 89-97 (L3) in the $V_L$, and 26-32 (H1), 52-56 (H2) and 95-101 (H3) in the $V_H$ when numbered in accordance with the Chothia numbering system; Chothia and Lesk, J. Mol. Biol. 196:901-917 (1987)); and/or those residues from a "hypervariable loop"/CDR (e.g., residues 27-38 (L1), 56-65 (L2) and 105-120 (L3) in the $V_L$, and 27-38 (H1), 56-65 (H2) and 105-120 (H3) in the $V_H$ when numbered in accordance with the IMGT numbering system; Lefranc, M. P. et al. Nucl. Acids Res. 27:209-212 (1999), Ruiz, M. e al. Nucl. Acids Res. 28:219-221 (2000)). Optionally the antibody has symmetrical insertions at one or more of the following points 28, 36 (L1), 63, 74-75 (L2) and 123 (L3) in the $V_L$, and 28, 36 (H1), 63, 74-75 (H2) and 123 (H3) in the $V_H$ when numbered in accordance with AHo; Honneger, A. and Plunkthun, A. J. Mol. Biol. 309:657-670 (2001)).

By "germline nucleic acid residue" is meant the nucleic acid residue that naturally occurs in a germline gene encoding a constant or variable region. "Germline gene" is the DNA found in a germ cell (i.e., a cell destined to become an egg or in the sperm). A "germline mutation" refers to a heritable change in a particular DNA that has occurred in a germ cell or the zygote at the single-cell stage, and when transmitted to offspring, such a mutation is incorporated in every cell of the body. A germline mutation is in contrast to a somatic mutation which is acquired in a single body cell. In some cases, nucleotides in a germline DNA sequence encoding for a variable region are mutated (i.e., a somatic mutation) and replaced with a different nucleotide.

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to polyclonal antibody preparations that include different antibodies directed against different determinants (epitopes), each monoclonal antibody is directed against a single determinant on the antigen. In addition to their specificity, the monoclonal antibodies are advantageous in that they may be synthesized uncontaminated by other antibodies. The modifier "monoclonal" is not to be construed as requiring production of the antibody by any particular method. For example, the monoclonal antibodies useful in the present invention may be prepared by the hybridoma methodology first described by Kohler et al., Nature, 256:495 (1975), or may be made using recombinant DNA methods in bacterial, eukaryotic animal or plant cells (see, e.g., U.S. Pat. No. 4,816, 567). The "monoclonal antibodies" may also be isolated from phage antibody libraries using the techniques described in Clackson et al., Nature, 352:624-628 (1991) and Marks et al., J. Mol. Biol., 222:581-597 (1991), for example.

The monoclonal antibodies herein include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (see U.S. Pat. No. 4,816,567; and Morrison et al., Proc. Natl. Acad. Sci. USA, 81:6851-6855 (1984)). The present invention provides variable domain antigen-binding sequences derived from human antibodies. Accordingly, chimeric antibodies of primary interest herein include antibodies having one or more human antigen binding sequences (e.g., CDRs) and containing one or more sequences derived from a non-human antibody, e.g., an FR or C region sequence. In addition, chimeric antibodies of primary interest herein include those comprising a human variable domain antigen binding sequence of one antibody class or subclass and another sequence, e.g., FR or C region sequence, derived from another antibody class or subclass. Chimeric antibodies of interest herein also include those containing variable domain antigen-binding sequences related to those described herein or derived from a different species, such as a non-human primate (e.g., Old World Monkey, Ape, etc). Chimeric antibodies also include primatized and humanized antibodies.

Furthermore, chimeric antibodies may comprise residues that are not found in the recipient antibody or in the donor antibody. These modifications are made to further refine antibody performance. For further details, see Jones et al., Nature 321:522-525 (1986); Riechmann et al., Nature 332:323-329 (1988); and Presta, Curr. Op. Struct. Biol. 2:593-596 (1992).

A "humanized antibody" is generally considered to be a human antibody that has one or more amino acid residues introduced into it from a source that is non-human. These non-human amino acid residues are often referred to as "import" residues, which are typically taken from an "import" variable domain. Humanization is traditionally performed following the method of Winter and co-workers (Jones et al., Nature, 321:522-525 (1986); Reichmann et al., Nature, 332:323-327 (1988); Verhoeyen et al., Science, 239: 1534-1536 (1988)), by substituting import hypervariable region sequences for the corresponding sequences of a human antibody. Accordingly, such "humanized" antibodies are chimeric antibodies (U.S. Pat. No. 4,816,567) wherein substantially less than an intact human variable domain has been substituted by the corresponding sequence from a non-human species.

A "human antibody" is an antibody containing only sequences present in an antibody naturally produced by a human. However, as used herein, human antibodies may comprise residues or modifications not found in a naturally occurring human antibody, including those modifications and variant sequences described herein. These are typically made to further refine or enhance antibody performance.

An "intact" antibody is one that comprises an antigen-binding site as well as a $C_L$ and at least heavy chain constant domains, $C_H1$, $C_H2$ and $C_H3$. The constant domains may be native sequence constant domains (e.g., human native sequence constant domains) or amino acid sequence variant thereof. Preferably, the intact antibody has one or more effector functions.

An "antibody fragment" comprises a portion of an intact antibody, preferably the antigen binding or variable region of the intact antibody. Examples of antibody fragments include Fab, Fab', F(ab')$_2$, and Fv fragments; diabodies; linear antibodies (see U.S. Pat. No. 5,641,870; Zapata et al., Protein Eng. 8(10): 1057-1062 [1995]); single-chain antibody molecules; and multispecific antibodies formed from antibody fragments.

The phrase "functional fragment or analog" of an antibody is a compound having qualitative biological activity in common with a full-length antibody. For example, a functional fragment or analog of an anti-IgE antibody is one that can bind to an IgE immunoglobulin in such a manner so as to prevent or substantially reduce the ability of such molecule from having the ability to bind to the high affinity receptor, Fc$_\epsilon$RI.

Papain digestion of antibodies produces two identical antigen-binding fragments, called "Fab" fragments, and a residual "Fc" fragment, a designation reflecting the ability to crystallize readily. The Fab fragment consists of an entire L chain along with the variable region domain of the H chain ($V_H$), and the first constant domain of one heavy chain ($C_H1$). Each Fab fragment is monovalent with respect to antigen binding, i.e., it has a single antigen-binding site. Pepsin treatment of an antibody yields a single large F(ab')$_2$ fragment that roughly corresponds to two disulfide linked Fab fragments having divalent antigen-binding activity and is still capable of cross-linking antigen. Fab' fragments differ from Fab fragments by having additional few residues at the carboxy terminus of the $C_H1$ domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments that have hinge cysteines between them. Other chemical couplings of antibody fragments are also known.

The "Fc" fragment comprises the carboxy-terminal portions of both H chains held together by disulfides. The effector functions of antibodies are determined by sequences in the Fc region, which region is also the part recognized by Fc receptors (FcR) found on certain types of cells.

"Fv" is the minimum antibody fragment that contains a complete antigen-recognition and -binding site. This fragment consists of a dimer of one heavy- and one light-chain variable region domain in tight, non-covalent association. From the folding of these two domains emanate six hypervariable loops (three loops each from the H and L chain) that contribute the amino acid residues for antigen binding and confer antigen binding specificity to the antibody. However, even a single variable domain (or half of an Fv comprising only three CDRs specific for an antigen) has the ability to recognize and bind antigen, although at a lower affinity than the entire binding site.

"Single-chain Fv" also abbreviated as "sFv" or "scFv" are antibody fragments that comprise the $V_H$ and $V_L$ antibody domains connected into a single polypeptide chain. Preferably, the sFv polypeptide further comprises a polypeptide linker between the $V_H$ and $V_L$ domains that enables the sFv to form the desired structure for antigen binding. For a review of sFv, see Pluckthun in The Pharmacology of Monoclonal Antibodies; vol. 113, Rosenburg and Moore eds., Springer-Verlag, New York, pp. 269-315 (1994); Borrebaeck 1995, infra.

The term "diabodies" refers to small antibody fragments prepared by constructing sFv fragments (see preceding paragraph) with short linkers (about 5-10 residues) between the $V_H$ and $V_L$ domains such that inter-chain but not intra-chain pairing of the V domains is achieved, resulting in a bivalent fragment, i.e., fragment having two antigen-binding sites. Bispecific diabodies are heterodimers of two "crossover" sFv fragments in which the $V_H$ and $V_L$ domains of the two antibodies are present on different polypeptide chains. Diabodies are described more fully in, for example, EP 404,097; WO 93/11161; and Hollinger et al., Proc. Natl. Acad. Sci. USA, 90:6444-6448 (1993).

As used herein, an antibody that "internalizes" is one that is taken up by (i.e., enters) the cell upon binding to an antigen on a mammalian cell (e.g., a cell surface polypeptide or receptor). The internalizing antibody will of course include antibody fragments, human or chimeric antibody, and antibody conjugates. For certain therapeutic applications, internalization in vivo is contemplated. The number of antibody molecules internalized will be sufficient or adequate to kill a cell or inhibit its growth, especially an infected cell. Depending on the potency of the antibody or antibody conjugate, in some instances, the uptake of a single antibody molecule into the cell is sufficient to kill the target cell to which the antibody binds. For example, certain toxins are highly potent in killing such that internalization of one molecule of the toxin conjugated to the antibody is sufficient to kill the infected cell.

As used herein, an antibody is said to be "immunospecific," "specific for" or to "specifically bind" an antigen if it reacts at a detectable level with the antigen, preferably with an affinity constant, $K_a$, of greater than or equal to about $10^4$ $M^{-1}$, or greater than or equal to about $10^5$ $M^{-1}$, greater than or equal to about $10^6$ $M^{-1}$, greater than or equal to about $10^7$ $M^{-1}$, or greater than or equal to $10^8$ $M^{-1}$. Affinity of an antibody for its cognate antigen is also commonly expressed as a dissociation constant $K_D$, and in certain embodiments, HuM2e antibody specifically binds to M2e if it binds with a $K_D$ of less than or equal to $10^{-4}$ M, less than or equal to about $10^{-5}$ M, less than or equal to about $10^{-6}$ M, less than or equal to $10^{-7}$ M, or less than or equal to $10^{-8}$ M. Affinities of antibodies can be readily determined using conventional techniques, for example, those described by Scatchard et al. (*Ann. N.Y. Acad. Sci. USA* 51:660 (1949)).

Binding properties of an antibody to antigens, cells or tissues thereof may generally be determined and assessed using immunodetection methods including, for example, immunofluorescence-based assays, such as immuno-histochemistry (IHC) and/or fluorescence-activated cell sorting (FACS).

An antibody having a "biological characteristic" of a designated antibody is one that possesses one or more of the biological characteristics of that antibody which distinguish it from other antibodies. For example, in certain embodiments, an antibody with a biological characteristic of a designated antibody will bind the same epitope as that bound by the designated antibody and/or have a common effector function as the designated antibody.

The term "antagonist" antibody is used in the broadest sense, and includes an antibody that partially or fully blocks, inhibits, or neutralizes a biological activity of an epitope, polypeptide, or cell that it specifically binds. Methods for identifying antagonist antibodies may comprise contacting a polypeptide or cell specifically bound by a candidate antagonist antibody with the candidate antagonist antibody and measuring a detectable change in one or more biological activities normally associated with the polypeptide or cell.

An "antibody that inhibits the growth of infected cells" or a "growth inhibitory" antibody is one that binds to and results in measurable growth inhibition of infected cells expressing or capable of expressing an M2e epitope bound by an antibody. Preferred growth inhibitory antibodies inhibit growth of infected cells by greater than 20%, preferably from about 20% to about 50%, and even more preferably, by greater than 50% (e.g., from about 50% to about 100%) as compared to the appropriate control, the control typically being infected cells not treated with the antibody being tested. Growth inhibition can be measured at an antibody concentration of about 0.1 to 30 µg/ml or about 0.5 nM to 200 nM in cell culture, where the growth inhibition is determined 1-10 days after exposure of the infected cells to the antibody. Growth inhibition of infected cells in vivo can be determined in various ways known in the art. The antibody is growth inhibitory in vivo if administration of the antibody at about 1 µg/kg to about 100 mg/kg body weight results in reduction the percent of infected cells or total number of infected cells within about 5 days to 3 months from the first administration of the antibody, preferably within about 5 to 30 days.

An antibody that "induces apoptosis" is one which induces programmed cell death as determined by binding of annexin V, fragmentation of DNA, cell shrinkage, dilation of endoplasmic reticulum, cell fragmentation, and/or formation of membrane vesicles (called apoptotic bodies). Preferably the cell is an infected cell. Various methods are available for evaluating the cellular events associated with apoptosis. For example, phosphatidyl serine (PS) translocation can be measured by annexin binding; DNA fragmentation can be evaluated through DNA laddering; and nuclear/chromatin condensation along with DNA fragmentation can be evaluated by any increase in hypodiploid cells. Preferably, the antibody that induces apoptosis is one that results in about 2 to 50 fold, preferably about 5 to 50 fold, and most preferably about 10 to 50 fold, induction of annexin binding relative to untreated cell in an annexin binding assay.

Antibody "effector functions" refer to those biological activities attributable to the Fc region (a native sequence Fc region or amino acid sequence variant Fc region) of an antibody, and vary with the antibody isotype. Examples of antibody effector functions include: C1q binding and complement dependent cytotoxicity; Fc receptor binding; antibody-dependent cell-mediated cytotoxicity (ADCC);

phagocytosis; down regulation of cell surface receptors (e.g., B cell receptor); and B cell activation.

"Antibody-dependent cell-mediated cytotoxicity" or "ADCC" refers to a form of cytotoxicity in which secreted Ig bound to Fc receptors (FcRs) present on certain cytotoxic cells (e.g., Natural Killer (NK) cells, neutrophils, and macrophages) enable these cytotoxic effector cells to bind specifically to an antigen-bearing target cell and subsequently kill the target cell with cytotoxins. The antibodies "arm" the cytotoxic cells and are required for such killing. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, Annu. Rev. Immunol 9:457-92 (1991). To assess ADCC activity of a molecule of interest, an in vitro ADCC assay, such as that described in U.S. Pat. No. 5,500,362 or U.S. Pat. No. 5,821,337 may be performed. Useful effector cells for such assays include peripheral blood mononuclear cells (PBMC) and Natural Killer (NK) cells. Alternatively, or additionally, ADCC activity of the molecule of interest may be assessed in vivo, e.g., in a animal model such as that disclosed in Clynes et al., PNAS (USA) 95:652-656 (1998).

"Fc receptor" or "FcR" describes a receptor that binds to the Fc region of an antibody. In certain embodiments, the FcR is a native sequence human FcR. Moreover, a preferred FcR is one that binds an IgG antibody (a gamma receptor) and includes receptors of the FcγRI, FcγRII, and FcγRIII subclasses, including allelic variants and alternatively spliced forms of these receptors. FCγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain. (see review M. in Daeron, Annu. Rev. Immunol. 15:203-234 (1997)). FcRs are reviewed in Ravetch and Kinet, Annu. Rev. Immunol 9:457-92 (1991); Capel et al., Immunomethods 4:25-34 (1994); and de Haas et al., J. Lab. Clin. Med. 126:330-41 (1995). Other FcRs, including those to be identified in the future, are encompassed by the term "FcR" herein. The term also includes the neonatal receptor, FcRn, which is responsible for the transfer of maternal IgGs to the fetus (Guyer et al., J. Immunol. 117:587 (1976) and Kim et al., J. Immunol. 24:249 (1994)).

"Human effector cells" are leukocytes that express one or more FcRs and perform effector functions. Preferably, the cells express at least FcγRIII and perform ADCC effector function. Examples of human leukocytes that mediate ADCC include PBMC, NK cells, monocytes, cytotoxic T cells and neutrophils; with PBMCs and NK cells being preferred. The effector cells may be isolated from a native source, e.g., from blood.

"Complement dependent cytotoxicity" or "CDC" refers to the lysis of a target cell in the presence of complement. Activation of the classical complement pathway is initiated by the binding of the first component of the complement system (C1q) to antibodies (of the appropriate subclass) that are bound to their cognate antigen. To assess complement activation, a CDC assay, e.g., as described in Gazzano-Santoro et al., J. Immunol. Methods 202:163 (1996), may be performed.

The terms "influenza A" and "Influenzavirus A" refer to a genus of the Orthomyxoviridae family of viruses. Influenzavirus A includes only one species: influenza A virus which cause influenza in birds, humans, pigs, and horses. Strains of all subtypes of influenza A virus have been isolated from wild birds, although disease is uncommon. Some isolates of influenza A virus cause severe disease both in domestic poultry and, rarely, in humans.

A "mammal" for purposes of treating n infection, refers to any mammal, including humans, domestic and farm animals, and zoo, sports, or pet animals, such as dogs, cats, cattle, horses, sheep, pigs, goats, rabbits, etc. Preferably, the mammal is human.

"Treating" or "treatment" or "alleviation" refers to both therapeutic treatment and prophylactic or preventative measures; wherein the object is to prevent or slow down (lessen) the targeted pathologic condition or disorder. Those in need of treatment include those already with the disorder as well as those prone to have the disorder or those in whom the disorder is to be prevented. A subject or mammal is successfully "treated" for an infection if, after receiving a therapeutic amount of an antibody according to the methods of the present invention, the patient shows observable and/or measurable reduction in or absence of one or more of the following: reduction in the number of infected cells or absence of the infected cells; reduction in the percent of total cells that are infected; and/or relief to some extent, one or more of the symptoms associated with the specific infection; reduced morbidity and mortality, and improvement in quality of life issues. The above parameters for assessing successful treatment and improvement in the disease are readily measurable by routine procedures familiar to a physician.

The term "therapeutically effective amount" refers to an amount of an antibody or a drug effective to "treat" a disease or disorder in a subject or mammal. See preceding definition of "treating."

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

Administration "in combination with" one or more further therapeutic agents includes simultaneous (concurrent) and consecutive administration in any order.

"Carriers" as used herein include pharmaceutically acceptable carriers, excipients, or stabilizers that are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™ polyethylene glycol (PEG), and PLURONICS™.

The term "cytotoxic agent" as used herein refers to a substance that inhibits or prevents the function of cells and/or causes destruction of cells. The term is intended to include radioactive isotopes (e.g., $At^{211}$, $I^{131}$, $I^{125}$, $Y^{90}$, $Re^{186}$, $Re^{188}$, $Sm^{153}$, $Bi^{212}$, $P^{32}$ and radioactive isotopes of Lu), chemotherapeutic agents e.g., methotrexate, adriamicin, vinca alkaloids (vincristine, vinblastine, etoposide), doxorubicin, melphalan, mitomycin C, chlorambucil, daunorubicin or other intercalating agents, enzymes and fragments thereof such as nucleolytic enzymes, antibiotics, and toxins such as small molecule toxins or enzymatically active toxins of bacterial, fungal, plant or animal origin, including fragments and/or variants thereof, and the various antitumor or anticancer agents disclosed below. Other cytotoxic agents are described below.

A "growth inhibitory agent" when used herein refers to a compound or composition which inhibits growth of a cell, either in vitro or in vivo. Examples of growth inhibitory agents include agents that block cell cycle progression, such as agents that induce G1 arrest and M-phase arrest. Classical M-phase blockers include the vinca alkaloids (vincristine, vinorelbine and vinblastine), taxanes, and topoisomerase II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in The Molecular Basis of Cancer, Mendelsohn and Israel, eds., Chapter 1, entitled "Cell cycle regulation, oncogenes, and antineoplastic drugs" by Murakami et al. (W B Saunders: Philadelphia, 1995), especially p. 13. The taxanes (paclitaxel and docetaxel) are anticancer drugs both derived from the yew tree. Docetaxel (TAXOTERETM, Rhone-Poulenc Rorer), derived from the European yew, is a semisynthetic analogue of paclitaxel (TAXOL®, Bristol-Myers Squibb). Paclitaxel and docetaxel promote the assembly of microtubules from tubulin dimers and stabilize microtubules by preventing depolymerization, which results in the inhibition of mitosis in cells.

"Label" as used herein refers to a detectable compound or composition that is conjugated directly or indirectly to the antibody so as to generate a "labeled" antibody. The label may be detectable by itself (e.g., radioisotope labels or fluorescent labels) or, in the case of an enzymatic label, may catalyze chemical alteration of a substrate compound or composition that is detectable.

The term "epitope tagged" as used herein refers to a chimeric polypeptide comprising a polypeptide fused to a "tag polypeptide." The tag polypeptide has enough residues to provide an epitope against which an antibody can be made, yet is short enough such that it does not interfere with activity of the polypeptide to which it is fused. The tag polypeptide is also preferably fairly unique so that the antibody does not substantially, cross-react with other epitopes. Suitable tag polypeptides generally have at least six amino acid residues and usually between about 8 and 50 amino acid residues (preferably, between about 10 and 20 amino acid residues).

A "small molecule" is defined herein to have a molecular weight below about 500 Daltons.

The terms "nucleic acid" and "polynucleotide" are used interchangeably herein to refer to single- or double-stranded RNA, DNA, or mixed polymers. Polynucleotides may include genomic sequences, extra-genomic and plasmid sequences, and smaller engineered gene segments that express, or may be adapted to express polypeptides.

An "isolated nucleic acid" is a nucleic acid that is substantially separated from other genome DNA sequences as well as proteins or complexes such as ribosomes and polymerases, which naturally accompany a native sequence. The term embraces a nucleic acid sequence that has been removed from its naturally occurring environment, and includes recombinant or cloned DNA isolates and chemically synthesized analogues or analogues biologically synthesized by heterologous systems. A substantially pure nucleic acid includes isolated forms of the nucleic acid. Of course, this refers to the nucleic acid as originally isolated and does not exclude genes or sequences later added to the isolated nucleic acid by the hand of man.

The term "polypeptide" is used in its conventional meaning, i.e., as a sequence of amino acids. The polypeptides are not limited to a specific length of the product. Peptides, oligopeptides, and proteins are included within the definition of polypeptide, and such terms may be used interchangeably herein unless specifically indicated otherwise. This term also does not refer to or exclude post-expression modifications of the polypeptide, for example, glycosylations, acetylations, phosphorylations and the like, as well as other modifications known in the art, both naturally occurring and non-naturally occurring. A polypeptide may be an entire protein, or a subsequence thereof. Particular polypeptides of interest in the context of this invention are amino acid subsequences comprising CDRs and being capable of binding an antigen or Influenza A-infected cell.

An "isolated polypeptide" is one that has been identified and separated and/or recovered from a component of its natural environment. In preferred embodiments, the isolated polypeptide will be purified (1) to greater than 95% by weight of polypeptide as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or non-reducing conditions using Coomassie blue or, preferably, silver stain. Isolated polypeptide includes the polypeptide in situ within recombinant cells since at least one component of the polypeptide's natural environment will not be present. Ordinarily, however, isolated polypeptide will be prepared by at least one purification step.

A "native sequence" polynucleotide is one that has the same nucleotide sequence as a polynucleotide derived from nature. A "native sequence" polypeptide is one that has the same amino acid sequence as a polypeptide (e.g., antibody) derived from nature (e.g., from any species). Such native sequence polynucleotides and polypeptides can be isolated from nature or can be produced by recombinant or synthetic means.

A polynucleotide "variant," as the term is used herein, is a polynucleotide that typically differs from a polynucleotide specifically disclosed herein in one or more substitutions, deletions, additions and/or insertions. Such variants may be naturally occurring or may be synthetically generated, for example, by modifying one or more of the polynucleotide sequences of the invention and evaluating one or more biological activities of the encoded polypeptide as described herein and/or using any of a number of techniques well known in the art.

A polypeptide "variant," as the term is used herein, is a polypeptide that typically differs from a polypeptide specifically disclosed herein in one or more substitutions, deletions, additions and/or insertions. Such variants may be naturally occurring or may be synthetically generated, for example, by modifying one or more of the above polypeptide sequences of the invention and evaluating one or more biological activities of the polypeptide as described herein and/or using any of a number of techniques well known in the art.

Modifications may be made in the structure of the polynucleotides and polypeptides of the present invention and still obtain a functional molecule that encodes a variant or derivative polypeptide with desirable characteristics. When it is desired to alter the amino acid sequence of a polypeptide to create an equivalent, or even an improved, variant or portion of a polypeptide of the invention, one skilled in the art will typically change one or more of the codons of the encoding DNA sequence.

For example, certain amino acids may be substituted for other amino acids in a protein structure without appreciable loss of its ability to bind other polypeptides (e.g., antigens) or cells. Since it is the binding capacity and nature of a protein that defines that protein's biological functional activity, certain amino acid sequence substitutions can be made in a protein sequence, and, of course, its underlying DNA coding sequence, and nevertheless obtain a protein with like properties. It is thus contemplated that various changes may be made in the peptide sequences of the disclosed compositions, or corresponding DNA sequences that encode said peptides without appreciable loss of their biological utility or activity.

In many instances, a polypeptide variant will contain one or more conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged.

In making such changes, the hydropathic index of amino acids may be considered. The importance of the hydropathic amino acid index in conferring interactive biologic function on a protein is generally understood in the art (Kyte and Doolittle, 1982). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of its hydrophobicity and charge characteristics (Kyte and Doolittle, 1982). These values are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is known in the art that certain amino acids may be substituted by other amino acids having a similar hydropathic index or score and still result in a protein with similar biological activity, i.e. still obtain a biological functionally equivalent protein. In making such changes, the substitution of amino acids whose hydropathic indices are within ±2 is preferred, those within ±1 are particularly preferred, and those within ±0.5 are even more particularly preferred. It is also understood in the art that the substitution of like amino acids can be made effectively on the basis of hydrophilicity. U.S. Pat. No. 4,554,101 states that the greatest local average hydrophilicity of a protein, as governed by the hydrophilicity of its adjacent amino acids, correlates with a biological property of the protein.

As detailed in U. S. Patent 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine and isoleucine.

Amino acid substitutions may further be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

Polypeptides may comprise a signal (or leader) sequence at the N-terminal end of the protein, which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

When comparing polynucleotide and polypeptide sequences, two sequences are said to be "identical" if the sequence of nucleotides or amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990) Unified Approach to Alignment and Phylogenes pp. 626-645 *Methods in Enzymology* vol. 183, Academic Press, Inc., San Diego, Calif.; Higgins, D. G. and Sharp, P. M. (1989) *CABIOS* 5:151-153; Myers, E.W. and Muller W. (1988)

CABIOS 4:11-17; Robinson, E. D. (1971) *Comb. Theor* 11:105; Santou, N. Nes, M. (1987) *Mol. Biol. Evol.* 4:406-425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726-730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) *Nucl. Acids Res.* 25:3389-3402 and Altschul et al. (1990) *J. Mol. Biol.* 215:403-410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information.

In one illustrative example, cumulative scores can be calculated using, for nucleotide sequences, the parameters M (reward score for a pair of matching residues; always >0) and N (penalty score for mismatching residues; always <0). Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff (1989) *Proc. Natl. Acad. Sci. USA* 89:10915) alignments, (B) of 50, expectation (E) of 10, M=5, N=−4 and a comparison of both strands.

For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment.

In one approach, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residues occur in both sequences to yield the number of matched positions, dividing the number of matched positions by the total number of positions in the reference sequence (i.e., the window size) and multiplying the results by 100 to yield the percentage of sequence identity.

"Homology" refers to the percentage of residues in the polynucleotide or polypeptide sequence variant that are identical to the non-variant sequence after aligning the sequences and introducing gaps, if necessary, to achieve the maximum percent homology. In particular embodiments, polynucleotide and polypeptide variants have at least 70%, at least 75%, at least 80%, at least 90%, at least 95%, at least 98%, or at least 99% polynucleotide or polypeptide homology with a polynucleotide or polypeptide described herein.

"Vector" includes shuttle and expression vectors. Typically, the plasmid construct will also include an origin of replication (e.g., the ColE1 origin of replication) and a selectable marker (e.g., ampicillin or tetracycline resistance), for replication and selection, respectively, of the plasmids in bacteria. An "expression vector" refers to a vector that contains the necessary control sequences or regulatory elements for expression of the antibodies including antibody fragment of the invention, in bacterial or eukaryotic cells. Suitable vectors are disclosed below.

As used in this specification and the appended claims, the singular forms "a," "an" and "the" include plural references unless the content clearly dictates otherwise.

The present invention includes human monoclonal anti-influenza antibodies comprising a polypeptide of the present invention, as well as fragments and variants thereof. In one embodiment, the antibody is an antibody designated herein as TCN-032 (8I10), 21B15, TCN-031 (23K12), 3241_G23, 3244_I10, 3243_J07, 3259_J21, 3245_O19, 3244_H04, 3136_G05, 3252_C13, 3255_J06, 3420_I23, 3139_P23, 3248_P18, 3253_P10, 3260_D19, 3362_B11, 3242_P05, TCN-522 (3212_I12), TCN-521 (3280_D18), TCN-523 (5248_A17), TCN-563 (5237_B21), TCN-526 (5084_C17), TCN-527 (5086_C06), TCN-528 (5087_P17), TCN-529 (5297_H01), TCN-530 (5248_H10), TCN-531 (5091_H13), TCN-532 (5262_H18), TCN-533 (5256_A17), TCN-534 (5249_B02), TCN-535 (5246_P19), TCN-536 (5095_N01), TCN-537 (3194_D21), TCN-538 (3206_D17), TCN-539 (5056_A08), TCN-540 (5060_F05), TCN-541 (5062_M11), TCN-542 (5079_A16), TCN-543 (5081_G23), TCN-544 (5082_A19), TCN-545 (5082_I15), TCN-546 (5089_L08), TCN-547 (5092_F11), TCN-548 (5092_P01), TCN-549 (5092_P04), TCN-550 (5096_F06), TCN-551 (5243_D01), TCN-552 (5249_I23), TCN-553 (5261_C18), TCN-554 (5277_M05), TCN-555 (5246_L16), TCN-556 (5089_K12), TCN-557 (5081_A04), TCN 558 (5248_H10b), TCN-559 (5097_G08), TCN-560 (5084_P10), TCN-504 (3251_K17), SC06-141, SC06-255, SC06-257, SC06-260, SC06-261, SC06-262, SC06-268, SC06-272, SC06-296, SC06-301, SC06-307, SC06-310, SC06-314, SC06-323, SC06-325, SC06-327, SC06-328, SC06-329, SC06-331, SC06-332, SC06-334, SC06-336, SC06-339, SC06-342, SC06-343, SC06-344, CR6141, CR6255, CR6257, CR6260, CR6261, CR6262, CR6268, CR6272, CR6296, CR6301, CR6307, CR6310, CR6314, CR6323, CR6325, CR6327, CR6328, CR6329, CR6331, CR6332, CR6334, CR6336, CR6339, CR6342, CR6343, or CR6344. These antibodies preferentially bind to or specifically bind to influenza A infected cells as compared to uninfected control cells of the same cell type.

In particular embodiments, the antibodies of the present invention bind to the M2 or HA protein. In certain embodiments, the present invention provides human anti-influenza antibodies that bind to epitopes within M2e or HA that are only present in the native conformation, i.e., as expressed in cells. In particular embodiments, these antibodies fail to specifically bind to an isolated M2e polypeptide, e.g., the 23 amino acid residue M2e fragment or an isolated HA polypeptide. It is understood that these antibodies recognize non-linear (i.e. conformational) epitope(s) of the M2 or HA peptide or protein.

These specific conformational epitopes within the M2 or HA protein, and particularly within M2e, may be used as vaccines to prevent the development of influenza infection within a subject.

As will be understood by the skilled artisan, general description of antibodies herein and methods of preparing and using the same also apply to individual antibody polypeptide constituents and antibody fragments.

The antibodies of the present invention may be polyclonal or monoclonal antibodies. However, in preferred embodiments, they are monoclonal. In particular embodiments, antibodies of the present invention are fully human antibodies. Methods of producing polyclonal and monoclonal antibodies are known in the art and described generally, e.g., in U.S. Pat. No. 6,824,780. Typically, the antibodies of the present invention are produced recombinantly, using vectors and methods available in the art, as described further below. Human antibodies may also be generated by in vitro activated B cells (see U.S. Pat. Nos. 5,567,610 and 5,229,275).

Human antibodies may also be produced in transgenic animals (e.g., mice) that are capable of producing a full repertoire of human antibodies in the absence of endogenous immunoglobulin production. For example, it has been described that the homozygous deletion of the antibody heavy-chain joining region ($J_H$) gene in chimeric and germ-line mutant mice results in complete inhibition of endogenous antibody production. Transfer of the human germ-line immunoglobulin gene array into such germ-line mutant mice results in the production of human antibodies upon antigen challenge. See, e.g., Jakobovits et al., Proc. Natl. Acad. Sci. USA, 90:2551 (1993); Jakobovits et al., Nature, 362:255-258 (1993); Bruggemann et al., Year in Immuno., 7:33 (1993); U.S. Pat. Nos. 5,545,806, 5,569,825, 5,591,669 (all of GenPharm); U.S. Pat. No. 5,545,807; and WO 97/17852. Such animals may be genetically engineered to produce human antibodies comprising a polypeptide of the present invention.

In certain embodiments, antibodies of the present invention are chimeric antibodies that comprise sequences derived from both human and non-human sources. In particular embodiments, these chimeric antibodies are humanized or primatized™. In practice, humanized antibodies are typically human antibodies in which some hypervariable region residues and possibly some FR residues are substituted by residues from analogous sites in rodent antibodies.

In the context of the present invention, chimeric antibodies also include fully human antibodies wherein the human hypervariable region or one or more CDRs are retained, but one or more other regions of sequence have been replaced by corresponding sequences from a non-human animal.

The choice of non-human sequences, both light and heavy, to be used in making the chimeric antibodies is important to reduce antigenicity and human anti-non-human antibody responses when the antibody is intended for human therapeutic use. It is further important that chimeric antibodies retain high binding affinity for the antigen and other favorable biological properties. To achieve this goal, according to a preferred method, chimeric antibodies are prepared by a process of analysis of the parental sequences and various conceptual chimeric products using three-dimensional models of the parental human and non-human sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the recipient and import sequences so that the desired antibody characteristic, such as increased affinity for the target antigen(s), is achieved. In general, the hypervariable region residues are directly and most substantially involved in influencing antigen binding.

As noted above, antibodies (or immunoglobulins) can be divided into five different classes, based on differences in the amino acid sequences in the constant region of the heavy chains. All immunoglobulins within a given class have very similar heavy chain constant regions. These differences can be detected by sequence studies or more commonly by serological means (i.e. by the use of antibodies directed to these differences). Antibodies, or fragments thereof, of the present invention may be any class, and may, therefore, have a gamma, mu, alpha, delta, or epsilon heavy chain. A gamma chain may be gamma 1, gamma 2, gamma 3, or gamma 4; and an alpha chain may be alpha 1 or alpha 2.

In a preferred embodiment, an antibody of the present invention, or fragment thereof, is an IgG. IgG is considered the most versatile immunoglobulin, because it is capable of carrying out all of the functions of immunoglobulin molecules. IgG is the major Ig in serum, and the only class of Ig that crosses the placenta. IgG also fixes complement, although the IgG4 subclass does not. Macrophages, monocytes, PMN's and some lymphocytes have Fc receptors for the Fc region of IgG. Not all subclasses bind equally well; IgG2 and IgG4 do not bind to Fc receptors. A consequence of binding to the Fc receptors on PMN's, monocytes and macrophages is that the cell can now internalize the antigen better. IgG is an opsonin that enhances phagocytosis. Binding of IgG to Fc receptors on other types of cells results in the activation of other functions. Antibodies of the present invention may be of any IgG subclass.

In another preferred embodiment, an antibody, or fragment thereof, of the present invention is an IgE. IgE is the least common serum Ig since it binds very tightly to Fc receptors on basophils and mast cells even before interacting with antigen. As a consequence of its binding to basophils an mast cells, IgE is involved in allergic reactions. Binding of the allergen to the IgE on the cells results in the release of various pharmacological mediators that result in allergic symptoms. IgE also plays a role in parasitic helminth diseases. Eosinophils have Fc receptors for IgE and binding of eosinophils to IgE-coated helminths results in killing of the parasite. IgE does not fix complement.

In various embodiments, antibodies of the present invention, and fragments thereof, comprise a variable light chain that is either kappa or lambda. The lamba chain may be any of subtype, including, e.g., lambda 1, lambda 2, lambda 3, and lambda 4.

As noted above, the present invention further provides antibody fragments comprising a polypeptide of the present invention. In certain circumstances there are advantages of using antibody fragments, rather than whole antibodies. For example, the smaller size of the fragments allows for rapid clearance, and may lead to improved access to certain tissues, such as solid tumors. Examples of antibody fragments include: Fab, Fab', F(ab')$_2$ and Fv fragments; diabodies; linear antibodies; single-chain antibodies; and multispecific antibodies formed from antibody fragments.

Various techniques have been developed for the production of antibody fragments. Traditionally, these fragments were derived via proteolytic digestion of intact antibodies (see, e.g., Morimoto et al., Journal of Biochemical and Biophysical Methods 24:107-117 (1992); and Brennan et al., Science, 229:81 (1985)). However, these fragments can now be produced directly by recombinant host cells. Fab, Fv and ScFv antibody fragments can all be expressed in and secreted from E. coli, thus allowing the facile production of large amounts of these fragments. Fab'-SH fragments can be directly recovered from E. coli and chemically coupled to form $F(ab')_2$ fragments (Carter et al., Bio/Technology 10:163-167 (1992)). According to another approach, $F(ab')_2$ fragments can be isolated directly from recombinant host cell culture. Fab and $F(ab')_2$ fragment with increased in vivo half-life comprising a salvage receptor binding epitope residues are described in U.S. Pat. No. 5,869,046. Other techniques for the production of antibody fragments will be apparent to the skilled practitioner.

In other embodiments, the antibody of choice is a single chain Fv fragment (scFv). See WO 93/16185; U.S. Pat. Nos. 5,571,894; and 5,587,458. Fv and sFv are the only species with intact combining sites that are devoid of constant regions. Thus, they are suitable for reduced nonspecific binding during in vivo use. sFv fusion proteins may be constructed to yield fusion of an effector protein at either the amino or the carboxy terminus of an sFv. See Antibody Engineering, ed. Borrebaeck, supra. The antibody fragment may also be a "linear antibody", e.g., as described in U.S. Pat. No. 5,641,870 for example. Such linear antibody fragments may be monospecific or bispecific.

In certain embodiments, antibodies of the present invention are bispecific or multi-specific. Bispecific antibodies are antibodies that have binding specificities for at least two different epitopes. Exemplary bispecific antibodies may bind to two different epitopes of a single antigen. Other such antibodies may combine a first antigen binding site with a binding site for a second antigen. Alternatively, an anti-M2e arm may be combined with an arm that binds to a triggering molecule on a leukocyte, such as a T-cell receptor molecule (e.g., CD3), or Fc receptors for IgG (FcγR), such as FcγRI (CD64), FcγRII (CD32) and FcγRIII (CD16), so as to focus and localize cellular defense mechanisms to the infected cell. Bispecific antibodies may also be used to localize cytotoxic agents to infected cells. These antibodies possess an M2e-binding arm and an arm that binds the cytotoxic agent (e.g., saporin, anti-interferon-α, vinca alkaloid, ricin A chain, methotrexate or radioactive isotope hapten). Bispecific antibodies can be prepared as full length antibodies or antibody fragments (e.g., $F(ab')_2$ bispecific antibodies). WO 96/16673 describes a bispecific anti-ErbB2/anti-FcγRIII antibody and U.S. Pat. No. 5,837,234 discloses a bispecific anti-ErbB2/anti-FcγRI antibody. A bispecific anti-ErbB2/Fcα antibody is shown in WO98/02463. U.S. Pat. No. 5,821,337 teaches a bispecific anti-ErbB2/anti-CD3 antibody.

Methods for making bispecific antibodies are known in the art. Traditional production of full length bispecific antibodies is based on the co-expression of two immunoglobulin heavy chain-light chain pairs, where the two chains have different specificities (Millstein et al., Nature, 305:537-539 (1983)). Because of the random assortment of immunoglobulin heavy and light chains, these hybridomas (quadromas) produce a potential mixture of ten different antibody molecules, of which only one has the correct bispecific structure. Purification of the correct molecule, which is usually done by affinity chromatography steps, is rather cumbersome, and the product yields are low. Similar procedures are disclosed in WO 93/08829, and in Traunecker et al., EMBO J., 10:3655-3659 (1991).

According to a different approach, antibody variable domains with the desired binding specificities (antibody-antigen combining sites) are fused to immunoglobulin constant domain sequences. Preferably, the fusion is with an Ig heavy chain constant domain, comprising at least part of the hinge, $C_H2$, and $C_H3$ regions. It is preferred to have the first heavy-chain constant region ($C_H1$) containing the site necessary for light chain bonding, present in at least one of the fusions. DNAs encoding the immunoglobulin heavy chain fusions and, if desired, the immunoglobulin light chain, are inserted into separate expression vectors, and are co-transfected into a suitable host cell. This provides for greater flexibility in adjusting the mutual proportions of the three polypeptide fragments in embodiments when unequal ratios of the three polypeptide chains used in the construction provide the optimum yield of the desired bispecific antibody. It is, however, possible to insert the coding sequences for two or all three polypeptide chains into a single expression vector when the expression of at least two polypeptide chains in equal ratios results in high yields or when the ratios have no significant affect on the yield of the desired chain combination.

In a preferred embodiment of this approach, the bispecific antibodies are composed of a hybrid immunoglobulin heavy chain with a first binding specificity in one arm, and a hybrid immunoglobulin heavy chain-light chain pair (providing a second binding specificity) in the other arm. It was found that this asymmetric structure facilitates the separation of the desired bispecific compound from unwanted immunoglobulin chain combinations, as the presence of an immunoglobulin light chain in only one half of the bispecific molecule provides for a facile way of separation. This approach is disclosed in WO 94/04690. For further details of generating bispecific antibodies see, for example, Suresh et al., Methods in Enzymology, 121:210 (1986).

According to another approach described in U.S. Pat. No. 5,731,168, the interface between a pair of antibody molecules can be engineered to maximize the percentage of heterodimers that are recovered from recombinant cell culture. The preferred interface comprises at least a part of the $C_H3$ domain. In this method, one or more small amino acid side chains from the interface of the first antibody molecule are replaced with larger side chains (e.g., tyrosine or tryptophan). Compensatory "cavities" of identical or similar size to the large side chain(s) are created on the interface of the second antibody molecule by replacing large amino acid side chains with smaller ones (e.g., alanine or threonine). This provides a mechanism for increasing the yield of the heterodimer over other unwanted end-products such as homodimers.

Bispecific antibodies include cross-linked or "heteroconjugate" antibodies. For example, one of the antibodies in the heteroconjugate can be coupled to avidin, the other to biotin. Such antibodies have, for example, been proposed to target immune system cells to unwanted cells (U.S. Pat. No. 4,676,980), and for treatment of HIV infection (WO 91/00360, WO 92/200373, and EP 03089). Heteroconjugate antibodies may be made using any convenient cross-linking methods. Suitable cross-linking agents are well known in the art, and are disclosed in U.S. Pat. No. 4,676,980, along with a number of cross-linking techniques.

Techniques for generating bispecific antibodies from antibody fragments have also been described in the literature. For example, bispecific antibodies can be prepared using chemical linkage. Brennan et al., Science, 229: 81 (1985) describe a procedure wherein intact antibodies are proteolytically cleaved to generate F(ab')$_2$ fragments. These fragments are reduced in the presence of the dithiol complexing agent, sodium arsenite, to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Recent progress has facilitated the direct recovery of Fab'-SH fragments from *E. coli*, which can be chemically coupled to form bispecific antibodies. Shalaby et al., J. Exp. Med., 175: 217-225 (1992) describe the production of a fully humanized bispecific antibody F(ab')$_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., J. Immunol., 148(5):1547-1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., Proc. Natl. Acad. Sci. USA, 90:6444-6448 (1993) has provided an alternative mechanism for making bispecific antibody fragments. The fragments comprise a $V_H$ connected to a $V_L$ by a linker that is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See Gruber et al., J. Immunol., 152:5368 (1994).

Antibodies with more than two valencies are contemplated. For example, trispecific antibodies can be prepared. Tutt et al., J. Immunol. 147: 60 (1991). A multivalent antibody may be internalized (and/or catabolized) faster than a bivalent antibody by a cell expressing an antigen to which the antibodies bind. The antibodies of the present invention can be multivalent antibodies with three or more antigen binding sites (e.g., tetravalent antibodies), which can be readily produced by recombinant expression of nucleic acid encoding the polypeptide chains of the antibody. The multivalent antibody can comprise a dimerization domain and three or more antigen binding sites. The preferred dimerization domain comprises (or consists of) an Fc region or a hinge region. In this scenario, the antibody will comprise an Fc region and three or more antigen binding sites amino-terminal to the Fc region. The preferred multivalent antibody herein comprises (or consists of) three to about eight, but preferably four, antigen binding sites. The multivalent antibody comprises at least one polypeptide chain (and preferably two polypeptide chains), wherein the polypeptide chain(s) comprise two or more variable domains. For instance, the polypeptide chain(s) may comprise VD1-(X1)$_n$-VD2-(X2)$_n$-Fc, wherein VD1 is a first variable domain, VD2 is a second variable domain, Fc is one polypeptide chain of an Fc region, X1 and X2 represent an amino acid or polypeptide, and n is 0 or 1. For instance, the polypeptide chain(s) may comprise: VH-CH1-flexible linker-VH-CH1-Fc region chain; or VH-CH1-VH-CH1-Fc region chain. The multivalent antibody herein preferably further comprises at least two (and preferably four) light chain variable domain polypeptides. The multivalent antibody herein may, for instance, comprise from about two to about eight light chain variable domain polypeptides. The light chain variable domain polypeptides contemplated here comprise a light chain variable domain and, optionally, further comprise a $C_L$ domain.

Antibodies of the present invention further include single chain antibodies.

In particular embodiments, antibodies of the present invention are internalizing antibodies.

Amino acid sequence modification(s) of the antibodies described herein are contemplated. For example, it may be desirable to improve the binding affinity and/or other biological properties of the antibody. Amino acid sequence variants of the antibody may be prepared by introducing appropriate nucleotide changes into a polynucleotide that encodes the antibody, or a chain thereof, or by peptide synthesis. Such modifications include, for example, deletions from, and/or insertions into and/or substitutions of, residues within the amino acid sequences of the antibody. Any combination of deletion, insertion, and substitution may be made to arrive at the final antibody, provided that the final construct possesses the desired characteristics. The amino acid changes also may alter post-translational processes of the antibody, such as changing the number or position of glycosylation sites. Any of the variations and modifications described above for polypeptides of the present invention may be included in antibodies of the present invention.

A useful method for identification of certain residues or regions of an antibody that are preferred locations for mutagenesis is called "alanine scanning mutagenesis" as described by Cunningham and Wells in Science, 244:1081-1085 (1989). Here, a residue or group of target residues are identified (e.g., charged residues such as arg, asp, his, lys, and glu) and replaced by a neutral or negatively charged amino acid (most preferably alanine or polyalanine) to affect the interaction of the amino acids with PSCA antigen. Those amino acid locations demonstrating functional sensitivity to the substitutions then are refined by introducing further or other variants at, or for, the sites of substitution. Thus, while the site for introducing an amino acid sequence variation is predetermined, the nature of the mutation per se need not be predetermined. For example, to analyze the performance of a mutation at a given site, ala scanning or random mutagenesis is conducted at the target codon or region and the expressed anti-antibody variants are screened for the desired activity.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue or the antibody fused to a cytotoxic polypeptide. Other insertional variants of an antibody include the fusion to the N- or C-terminus of the antibody to an enzyme (e.g., for ADEPT) or a polypeptide that increases the serum half-life of the antibody.

Another type of variant is an amino acid substitution variant. These variants have at least one amino acid residue in the antibody molecule replaced by a different residue. The sites of greatest interest for substitutional mutagenesis include the hypervariable regions, but FR alterations are also contemplated. Conservative and non-conservative substitutions are contemplated.

Substantial modifications in the biological properties of the antibody are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain.

Any cysteine residue not involved in maintaining the proper conformation of the antibody also may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

One type of substitutional variant involves substituting one or more hypervariable region residues of a parent antibody. Generally, the resulting variant(s) selected for further development will have improved biological properties relative to the parent antibody from which they are generated. A convenient way for generating such substitutional variants involves affinity maturation using phage display. Briefly, several hypervariable region sites (e.g., 6-7 sites) are mutated to generate all possible amino substitutions at each site. The antibody variants thus generated are displayed in a monovalent fashion.from filamentous phage particles as fusions to the gene III product of M13 packaged within each particle. The phage-displayed variants are then screened for their biological activity (e.g., binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the antibody and an antigen or infected cell. Such contact residues and neighboring residues are candidates for substitution according to the techniques elaborated herein. Once such variants are generated, the panel of variants is subjected to screening as described herein and antibodies with superior properties in one or more relevant assays may be selected for further development.

Another type of amino acid variant of the antibody alters the original glycosylation pattern of the antibody. By altering is meant deleting one or more carbohydrate moieties found in the antibody, and/or adding one or more glycosylation sites that are not present in the antibody.

Glycosylation of antibodies is typically either N-linked or O-linked. N-linked refers to the attachment of the carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-aceylgalactosamine, galactose, or xylose to a hydroxyamino acid, most commonly serine or threonine, although 5-hydroxyproline or 5-hydroxylysine may also be used.

Addition of glycosylation sites to the antibody is conveniently accomplished by altering the amino acid sequence such that it contains one or more of the above-described tripeptide sequences (for N-linked glycosylation sites). The alteration may also be made by the addition of, or substitution by, one or more serine or threonine residues to the sequence of the original antibody (for O-linked glycosylation sites).

The antibody of the invention is modified with respect to effector function, e.g., so as to enhance antigen-dependent cell-mediated cyotoxicity (ADCC) and/or complement dependent cytotoxicity (CDC) of the antibody. This may be achieved by introducing one or more amino acid substitutions in an Fc region of the antibody. Alternatively or additionally, cysteine residue(s) may be introduced in the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., J. Exp Med. 176: 1191-1195 (1992) and Shopes, B. J. Immunol. 148:2918-2922 (1992). Homodimeric antibodies with enhanced anti-infection activity may also be prepared using heterobifunctional cross-linkers as described in Wolff et al., Cancer Research 53:2560-2565 (1993). Alternatively, an antibody can be engineered which has dual Fc regions and may thereby have enhanced complement lysis and ADCC capabilities. See Stevenson et al., Anti-Cancer Drug Design 3:219-230 (1989).

To increase the serum half-life of the antibody, one may incorporate a salvage receptor binding epitope into the antibody (especially an antibody fragment) as described in U.S. Pat. No. 5,739,277, for example. As used herein, the term "salvage receptor binding epitope" refers to an epitope of the Fc region of an IgG molecule (e.g., $IgG_1$, $IgG_2$, $IgG_3$, or $IgG_4$) that is responsible for increasing the in vivo serum half-life of the IgG molecule.

Antibodies of the present invention may also be modified to include an epitope tag or label, e.g., for use in purification or diagnostic applications. The invention also pertains to therapy with immunoconjugates comprising an antibody conjugated to an anti-cancer agent such as a cytotoxic agent or a growth inhibitory agent. Chemotherapeutic agents useful in the generation of such immunoconjugates have been described above.

Conjugates of an antibody and one or more small molecule toxins, such as a calicheamicin, maytansinoids, a trichothene, and CC1065, and the derivatives of these toxins that have toxin activity, are also contemplated herein.

In one preferred embodiment, an antibody (full length or fragments) of the invention is conjugated to one or more maytansinoid molecules. Maytansinoids are mitototic inhibitors that act by inhibiting tubulin polymerization. Maytansine was first isolated from the east African shrub Maytenus serrata (U.S. Pat. No. 3,896,111). Subsequently, it was discovered that certain microbes also produce maytansinoids, such as maytansinol and C-3 maytansinol esters (U.S. Pat. No. 4,151,042). Synthetic maytansinol and derivatives and analogues thereof are disclosed, for example, in U.S. Pat. Nos. 4,137,230; 4,248,870; 4,256,746; 4,260,608; 4,265,814; 4,294,757; 4,307,016; 4,308,268; 4,308,269; 4,309,428; 4,313,946; 4,315,929; 4,317,821; 4,322,348; 4,331,598; 4,361,650; 4,364,866; 4,424,219; 4,450,254; 4,362,663; and 4,371,533.

In an attempt to improve their therapeutic index, maytansine and maytansinoids have been conjugated to antibodies specifically binding to tumor cell antigens. Immunoconjugates containing maytansinoids and their therapeutic use are disclosed, for example, in U.S. Pat. Nos. 5,208,020, 5,416,064 and European Patent EP 0 425 235 B1. Liu et al., Proc. Natl. Acad. Sci. USA 93:8618-8623 (1996) described immunoconjugates comprising a maytansinoid designated DM1 linked to the monoclonal antibody C242 directed against human colorectal cancer. The conjugate was found to be highly cytotoxic towards cultured colon cancer cells, and showed antitumor activity in an in vivo tumor growth assay.

Antibody-maytansinoid conjugates are prepared by chemically linking an antibody to a maytansinoid molecule without significantly diminishing the biological activity of either the antibody or the maytansinoid molecule. An average of 3-4 maytansinoid molecules conjugated per antibody molecule has shown efficacy in enhancing cytotoxicity of target cells without negatively affecting the function or solubility of the antibody, although even one molecule of toxin/antibody would be expected to enhance cytotoxicity over the use of naked antibody. Maytansinoids are well known in the art and can be synthesized by known techniques or isolated from natural sources. Suitable maytansinoids are disclosed, for example, in U.S. Pat. No. 5,208,020 and in the other patents and nonpatent publications referred to hereinabove. Preferred maytansinoids are maytansinol and maytansinol analogues modified in the aromatic ring or at other positions of the maytansinol molecule, such as various maytansinol esters.

There are many linking groups known in the art for making antibody conjugates, including, for example, those disclosed in U.S. Pat. No. 5,208,020 or EP Patent 0 425 235 B1, and Chari et al., Cancer Research 52: 127-131 (1992). The linking groups include disufide groups, thioether groups, acid labile groups, photolabile groups, peptidase labile groups, or esterase labile groups, as disclosed in the above-identified patents, disulfide and thioether groups being preferred.

Immunoconjugates may be made using a variety of bifunctional protein coupling agents such as N-succinimidyl-3-(2-pyridyldithio)propionate (SPDP), succinimidyl-4-(N-maleimidomethyl)cyclohexane-1-carboxylate, iminothiolane (IT), bifunctional derivatives of imidoesters (such as dimethyl adipimidate HCL), active esters (such as disuccinimidyl suberate), aldehydes (such as glutareldehyde), bis-azido compounds (such as bis(p-azidobenzoyl)hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). Particularly preferred coupling agents include N-succinimidyl-3-(2-pyridyldithio)propionate (SPDP) (Carlsson et al., Biochem. J. 173:723-737 [1978]) and N-succinimidyl-4-(2-pyridylthio)pentanoate (SPP) to provide for a disulfide linkage. For example, a ricin immunotoxin can be prepared as described in Vitetta et al., Science 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026. The linker may be a "cleavable linker" facilitating release of the cytotoxic drug in the cell. For example, an acid-labile linker, Cancer Research 52: 127-131 (1992); U.S. Pat. No. 5,208, 020) may be used.

Another immunoconjugate of interest comprises an antibody conjugated to one or more calicheamicin molecules. The calicheamicin family of antibiotics are capable of producing double-stranded DNA breaks at sub-picomolar concentrations. For the preparation of conjugates of the calicheamicin family, see U.S. Pat. Nos. 5,712,374, 5,714,586, 5,739,116, 5,767,285, 5,770,701, 5,770,710, 5,773,001, 5,877,296 (all to American Cyanamid Company). Another drug that the antibody can be conjugated is QFA which is an antifolate. Both calicheamicin and QFA have intracellular sites of action and do not readily cross the plasma membrane. Therefore, cellular uptake of these agents through antibody mediated internalization greatly enhances their cytotoxic effects.

Examples of other agents that can be conjugated to the antibodies of the invention include BCNU, streptozoicin, vincristine and 5-fluorouracil, the family of agents known collectively LL-E33288 complex described in U.S. Pat. Nos. 5,053,394, 5,770,710, as well as esperamicins (U.S. Pat. No. 5,877,296).

Enzymatically active toxins and fragments thereof that can be used include, e.g., diphtheria A chain, nonbinding active fragments of diphtheria toxin, exotoxin A chain (from Pseudomonas aeruginosa), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin and the tricothecenes. See, for example, WO 93/21232.

The present invention further includes an immunoconjugate formed between an antibody and a compound with nucleolytic activity (e.g., a ribonuclease or a DNA endonuclease such as a deoxyribonuclease; DNase).

For selective destruction of infected cells, the antibody includes a highly radioactive atom. A variety of radioactive isotopes are available for the production of radioconjugated anti-PSCA antibodies. Examples include $At^{211}$, $I^{131}$, $I^{125}$, $Y^{90}$, $Re^{186}$, $Re^{188}$, $Sm^{153}$, $Bi^{212}$, $P^{32}$, $Pb^{212}$ and radioactive isotopes of Lu. When the conjugate is used for diagnosis, it may comprise a radioactive atom for scintigraphic studies, for example $tc^{99m}$ or $I^{123}$, or a spin label for nuclear magnetic resonance (NMR) imaging (also known as magnetic resonance imaging, mri), such as iodine-123, iodine-131, indium-111, fluorine-19, carbon-13, nitrogen-15, oxygen-17, gadolinium, manganese or iron.

The radio- or other label is incorporated in the conjugate in known ways. For example, the peptide may be biosynthesized or may be synthesized by chemical amino acid synthesis using suitable amino acid precursors involving, for example, fluorine-19 in place of hydrogen. Labels such as $tc^{99m}$ or $I^{123}$, $Re^{186}$, $Re^{188}$ and $In^{111}$ can be attached via a cysteine residue in the peptide. Yttrium-90 can be attached via a lysine residue. The IODOGEN method (Fraker et al. (1978) Biochem. Biophys. Res. Commun. 80: 49-57 can be used to incorporate iodine-123. "Monoclonal Antibodies in Immunoscintigraphy" (Chatal,CRC Press 1989) describes other methods in detail.

Alternatively, a fusion protein comprising the antibody and cytotoxic agent is made, e.g., by recombinant techniques or peptide synthesis. The length of DNA may comprise respective regions encoding the two portions of the conjugate either adjacent one another or separated by a region encoding a linker peptide which does not destroy the desired properties of the conjugate.

The antibodies of the present invention are also used in antibody dependent enzyme mediated prodrug therapy (ADET) by conjugating the antibody to a prodrug-activating enzyme which converts a prodrug (e.g., a peptidyl chemotherapeutic agent, see WO81/01145) to an active anti-cancer drug (see, e.g., WO 88/07378 and U.S. Pat. No. 4,975,278).

The enzyme component of the immunoconjugate useful for ADEPT includes any enzyme capable of acting on a prodrug in such a way so as to covert it into its more active, cytotoxic form. Enzymes that are useful in the method of this invention include, but are not limited to, alkaline phosphatase useful for converting phosphate-containing prodrugs into free drugs; arylsulthase useful for converting sulfate-containing prodrugs into free drugs; cytosine deaminase useful for converting non-toxic 5-fluorocytosine into the anti-cancer drug, 5-fluorouracil; proteases, such as serratia protease, thermolysin, subtilisin, carboxypeptidases and cathepsins (such as cathepsins B and L), that are useful for converting peptide-containing prodrugs into free drugs; D-alanylcarboxypeptidases, useful for converting prodrugs that contain D-amino acid substituents; carbohydrate-cleaving enzymes such as β-galactosidase and neuraminidase useful for converting glycosylated prodrugs into free drugs; β-lactamase useful for converting drugs derivatized with β-lactams into free drugs; and penicillin amidases, such as penicillin V amidase or penicillin G amidase, useful for converting drugs derivatized at their amine nitrogens with phenoxyacetyl or phenylacetyl groups, respectively, into free drugs. Alternatively, antibodies with enzymatic activity, also known in the art as "abzymes", can be used to convert the prodrugs of the invention into free active drugs (see, e.g., Massey, Nature 328: 457-458 (1987)). Antibody-abzyme conjugates can be prepared as described herein for delivery of the abzyme to a infected cell population.

The enzymes of this invention can be covalently bound to the antibodies by techniques well known in the art such as the use of the heterobifunctional crosslinking reagents discussed above. Alternatively, fusion proteins comprising at least the antigen binding region of an antibody of the invention linked to at least a functionally active portion of an enzyme of the invention can be constructed using recombinant DNA techniques well known in the art (see, e.g., Neuberger et al., Nature, 312: 604-608 (1984).

Other modifications of the antibody are contemplated herein. For example, the antibody may be linked to one of a variety of nonproteinaceous polymers, e.g., polyethylene glycol, polypropylene glycol, polyoxyalkylenes, or copolymers of polyethylene glycol and polypropylene glycol. The antibody also may be entrapped in microcapsules prepared, for example, by coacervation techniques or by interfacial polymerization (for example, hydroxymethylcellulose or gelatin-microcapsules and poly-(methylmethacylate) microcapsules, respectively), in colloidal drug delivery systems (for example, liposomes, albumin microspheres, microemulsions, nano-particles and nanocapsules), or in macroemulsions. Such techniques are disclosed in Remington's Pharmaceutical Sciences, 16th edition, Oslo, A., Ed., (1980).

The antibodies disclosed herein are also formulated as immunoliposomes. A "liposome" is a small vesicle composed of various types of lipids, phospholipids and/or surfactant that is useful for delivery of a drug to a mammal. The components of the liposome are commonly arranged in a bilayer formation, similar to the lipid arrangement of biological membranes. Liposomes containing the antibody are prepared by methods known in the art, such as described in Epstein et al., Proc. Natl. Acad. Sci. USA, 82:3688 (1985); Hwang et al., Proc. Natl Acad. Sci. USA, 77:4030 (1980); U.S. Pat. Nos. 4,485,045 and 4,544,545; and WO97/38731 published Oct. 23, 1997. Liposomes with enhanced circulation time are disclosed in U.S. Pat. No. 5,013,556.

Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired a diameter. Fab' fragments of the antibody of the present invention can be conjugated to the liposomes as described in Martin et al., J. Biol. Chem. 257: 286-288 (1982) via a disulfide interchange reaction. A chemotherapeutic agent is optionally contained within the liposome. See Gabizon et al., J. National Cancer Inst. 81(19)1484 (1989).

Antibodies of the present invention, or fragments thereof, may possess any of a variety of biological or functional characteristics. In certain embodiments, these antibodies are Influenza A specific or M2 protein specific antibodies, indicating that they specifically bind to or preferentially bind to Influenza A or the M2 protein thereof, respectively, as compared to a normal control cell. In particular embodiments, the antibodies are HuM2e antibodies, indicating that they specifically bind to a M2e protein, preferably to an epitope of the M2e domain that is only present when the M2 protein is expressed in cells or present on a virus, as compared to a normal control cell.

In particular embodiments, an antibody of the present invention is an antagonist antibody, which partially or fully blocks or inhibits a biological activity of a polypeptide or cell to which it specifically or preferentially binds. In other embodiments, an antibody of the present invention is a growth inhibitory antibody, which partially or fully blocks or inhibits the growth of an infected cell to which it binds. In another embodiment, an antibody of the present invention induces apoptosis. In yet another embodiment, an antibody of the present invention induces or promotes antibody-dependent cell-mediated cytotoxicity or complement dependent cytotoxicity.

Methods of Identifying and Producing Antibodies Specific for Influenza Virus

The present invention provides novel methods for the identification of human anti-influenza antibodies raised against the M2e protein, as exemplified in Example 4, and for the identification of human anti-influenza antibodies raised against the HA protein, as exemplified in Example 13. These methods may be readily adapted to identify antibodies specific for other polypeptides expressed on the cell surface by infectious agents, or even polypeptides expressed on the surface of an infectious agent itself.

In general, the methods include obtaining serum samples from patients that have been infected with or vaccinated against an infectious agent. These serum samples are then screened to identify those that contain antibodies specific for a particular polypeptide associated with the infectious agent, such as, e.g., a polypeptide or protein specifically expressed on the surface of cells infected with the infectious agent, but not uninfected cells. In particular embodiments, the serum samples are screened by contacting the samples with a cell that has been transfected with an expression vector that expresses the polypeptide expressed on the surface of infected cells.

Once a patient is identified as having serum containing an antibody specific for the infectious agent polypeptide of interest is identified, mononuclear and/or B cells obtained from the same patient are used to identify a cell or clone thereof that produces the antibody, using any of the methods described herein or available in the art. Once a B cell that produces the antibody is identified, cDNAs encoding the variable regions or fragments thereof of the antibody may be cloned using standard RT-PCR vectors and primers specific for conserved antibody sequences, and subcloned in to expression vectors used for the recombinant production of monoclonal antibodies specific for the infectious agent polypeptide of interest.

In one embodiment, the present invention provides a method of identifying an antibody that specifically binds influenza A-infected cells, comprising: contacting an Influenza A virus or a cell expressing the M2 protein with a biological sample obtained from a patient having been infected by Influenza A; determining an amount of antibody in the biological sample that binds to the cell; and comparing the amount determined with a control value, wherein if the value determined is at least two-fold greater than the control value, an antibody that specifically binds influenza A-infected cells is indicated.

In various embodiments, the cells expressing an M2 or HA protein are cells infected with an Influenza A virus or cells that have been transfected with a polynucleotide that expressed the M2 or HA protein. Alternatively, the cells may express a portion of the M2 protein that includes the M2e domain and enough additional M2 sequence that the protein remains associated with the cell and the M2e domain is presented on the cell surface in the same manner as when present within full length M2 protein. Methods of preparing an M2 or HA expression vector and transfecting an appropriate cell, including those described herein, may be readily accomplished, in view of the M2 and HA sequences being publicly available. See, for example, the Influenza Sequence Database (ISD) (flu.lanl.gov on the World Wide Web, described in Macken et al., 2001, "The value of a database in surveillance and vaccine selection" in Options for the Control of Influenza IV. A.D.M.E., Osterhaus & Hampson (Eds.), Elsevier Science, Amsterdam, pp. 103-106) and the Microbial Sequencing Center (MSC) at The Institute for Genomic Research (TIGR) (tigr.org/msc/infl_a_virus.shtml on the World Wide Web).

The M2e- or HA-expressing cells or virus described above are used to screen the biological sample obtained from a patient infected with influenza A for the presence of antibodies that preferentially bind to the cell expressing the M2 or HA polypeptide using standard biological techniques. For example, in certain embodiments, the antibodies may be labeled, and the presence of label associated with the cell detected, e.g., using FMAT or FACs analysis. In particular embodiments, the biological sample is blood, serum, plasma, bronchial lavage, or saliva. Methods of the present invention may be practiced using high throughput techniques.

Identified human antibodies may then be characterized further. For example the particular conformational epitopes with in the M2e or HA protein that are necessary or sufficient for binding of the antibody may be determined, e.g., using site-directed mutagenesis of expressed M2e or HA polypeptides. These methods may be readily adapted to identify human antibodies that bind any protein expressed on a cell surface. Furthermore, these methods may be adapted to determine binding of the antibody to the virus itself, as opposed to a cell expressing recombinant M2e or HA, or infected with the virus.

Polynucleotide sequences encoding the antibodies, variable regions thereof, or antigen-binding fragments thereof may be subcloned into expression vectors for the recombinant production of human monoclonal anti-M2e or anti-HA antibodies. In one embodiment, this is accomplished by obtaining mononuclear cells from the patient from the serum containing the identified human monoclonal anti-M2e or anti-HA antibody was obtained; producing B cell clones from the mononuclear cells; inducing the B cells to become antibody-producing plasma cells; and screening the supernatants produced by the plasma cells to determine if it contains the human monoclonal anti-M2e or anti-HA antibody. Once a B cell clone that produces a human monoclonal anti-M2e or anti-HA antibody is identified, reverse-transcription polymerase chain reaction (RT-PCR) is performed to clone the DNAs encoding the variable regions or portions thereof of the human monoclonal anti-M2e or anti-HA antibody. These sequences are then subcloned into expression vectors suitable for the recombinant production of human monoclonal anti-M2e or anti-HA antibodies. The binding specificity may be confirmed by determining the recombinant antibody's ability to bind cells expressing M2e or HA polypeptide or protein.

In particular embodiments of the methods described herein, B cells isolated from peripheral blood or lymph nodes are sorted, e.g., based on their being CD19 positive, and plated, e.g., as low as a single cell specificity per well, e.g., in 96, 384, or 1536 well configurations. The cells are induced to differentiate into antibody-producing cells, e.g., plasma cells, and the culture supernatants are harvested and tested for binding to cells expressing the infectious agent polypeptide on their surface using, e.g., FMAT or FACS analysis. Positive wells are then subjected to whole well RT-PCR to amplify heavy and light chain variable regions of the IgG molecule expressed by the clonal daughter plasma cells. The resulting PCR products encoding the heavy and light chain variable regions, or portions thereof, are subcloned into human antibody expression vectors for recombinant expression. The resulting recombinant antibodies are then tested to confirm their original binding specificity and may be further tested for pan-specificity across various strains of isolates of the infectious agent.

Thus, in one embodiment, a method of identifying human monoclonal anti-M2e or anti-HA antibodies is practiced as follows. First, full length or approximately full length M2 or HA cDNAs are transfected into a cell line for expression of M2 or HA protein. Secondly, individual human plasma or sera samples are tested for antibodies that bind the cell-expressed M2 or HA. And lastly, MAbs derived from plasma- or serum-positive individuals are characterized for binding to the same cell-expressed M2 or HA. Further definition of the fine specificities of the MAbs can be performed at this point.

These methods may be practiced to identify a variety of different HuM2e antibodies, including antibodies specific for (a) epitopes in a linear M2e peptide, (b) common epitopes in multiple variants of M2e, (c) conformational determinants of an M2 homotetramer, and (d) common conformational determinants of multiple variants of the M2 homotetramer. The last category is particularly desirable, as this specificity is perhaps specific for all A strains of influenza.

These methods may be practiced to identify a variety of different human monoclonal anti-HA antibodies, including antibodies specific for (a) epitopes in a linear HA peptide, (b) common epitopes in multiple variants of HA, (c) conformational determinants of an HA protein or homotrimer, and (d) common conformational determinants of multiple variants of the HA protein or homotrimer. The last category is particularly desirable, as this specificity is perhaps specific for all A strains of influenza.

Polynucleotides that encode the human monoclonal anti-M2e or anti-HA antibodies or portions thereof of the present invention may be isolated from cells expressing human monoclonal anti-M2e or anti-HA antibodies, according to methods available in the art and described herein, including amplification by polymerase chain reaction using primers specific for conserved regions of human antibody polypeptides. For example, light chain and heavy chain variable regions may be cloned from the B cell according to molecular biology techniques described in WO 92/02551; U.S. Pat. No. 5,627,052; or Babcook et al., *Proc. Natl. Acad. Sci. USA* 93:7843-48 (1996). In certain embodiments, polynucleotides encoding all or a region of both the heavy and light chain variable regions of the IgG molecule expressed by the clonal daughter plasma cells expressing the human monoclonal anti-M2e or anti-HA antibody are subcloned and sequenced. The sequence of the encoded polypeptide may be readily determined from the polynucleotide sequence.

Isolated polynucleotides encoding a polypeptide of the present invention may be subcloned into an expression vector to recombinantly produce antibodies and polypeptides of the present invention, using procedures known in the art and described herein.

Binding properties of an antibody (or fragment thereof) to M2e or infected cells or tissues may generally be determined and assessed using immunodetection methods including, for example, immunofluorescence-based assays, such as immuno-histochemistry (IHC) and/or fluorescence-activated cell sorting (FACS). Immunoassay methods may include controls and procedures to determine whether antibodies bind specifically to M2e from one or more specific strains of Influenza A, and do not recognize or cross-react with normal control cells.

Following pre-screening of serum to identify patients that produce antibodies to an infectious agent or polypeptide thereof, e.g., M2 or HA, the methods of the present invention typically include the isolation or purification of B cells from a biological sample previously obtained from a patient or subject. The patient or subject may be currently or previously diagnosed with or suspect or having a particular disease or infection, or the patient or subject may be considered free or a particular disease or infection. Typically, the patient or subject is a mammal and, in particular embodiments, a human. The biological sample may be any sample that contains B cells, including but not limited to, lymph node or lymph node tissue, pleural effusions, peripheral blood, ascites, tumor tissue, or cerebrospinal fluid (CSF). In various embodiments, B cells are isolated from different types of biological samples, such as a biological sample affected by a particular disease or infection. However, it is understood that any biological sample comprising B cells may be used for any of the embodiments of the present invention.

Once isolated, the B cells are induced to produce antibodies, e.g., by culturing the B cells under conditions that support B cell proliferation or development into a plasmacyte, plasmablast, or plasma cell. The antibodies are then screened, typically using high throughput techniques, to identify an antibody that specifically binds to a target antigen, e.g., a particular tissue, cell, infectious agent, or polypeptide. In certain embodiments, the specific antigen, e.g., cell surface polypeptide bound by the antibody is not known, while in other embodiments, the antigen specifically bound by the antibody is known.

According to the present invention, B cells may be isolated from a biological sample, e.g., a tumor, tissue, peripheral blood or lymph node sample, by any means known and available in the art. B cells are typically sorted by FACS based on the presence on their surface of a B cell-specific marker, e.g., CD19, CD138, and/or surface IgG. However, other methods known in the art may be employed, such as, e.g., column purification using CD19 magnetic beads or IgG-specific magnetic beads, followed by elution from the column. However, magnetic isolation of B cells utilizing any marker may result in loss of certain B cells. Therefore, in certain embodiments, the isolated cells are not sorted but, instead, phicol-purified mononuclear cells isolated from tumor are directly plated to the appropriate or desired number of specificities per well.

In order to identify B cells that produce an infectious agent-specific antibody, the B cells are typically plated at low density (e.g., a single cell specificity per well, 1-10 cells per well, 10-100 cells per well, 1-100 cells per well, less than 10 cells per well, or less than 100 cells per well) in multi-well or microtitre plates, e.g., in 96, 384, or 1536 well configurations. When the B cells are initially plated at a density greater than one cell per well, then the methods of the present invention may include the step of subsequently diluting cells in a well identified as producing an antigen-specific antibody, until a single cell specificity per well is achieved, thereby facilitating the identification of the B cell that produces the antigen-specific antibody. Cell supernatants or a portion thereof and/or cells may be frozen and stored for future testing and later recovery of antibody polynucleotides.

In certain embodiments, the B cells are cultured under conditions that favor the production of antibodies by the B cells. For example, the B cells may be cultured under conditions favorable for B cell proliferation and differentiation to yield antibody-producing plasmablast, plasmacytes, or plasma cells. In particular embodiments, the B cells are cultured in the presence of a B cell mitogen, such as lipopolysaccharide (LPS) or CD40 ligand. In one specific embodiment, B cells are differentiated to antibody-producing cells by culturing them with feed cells and/or other B cell activators, such as CD40 ligand.

Cell culture supernatants or antibodies obtained therefrom may be tested for their ability to bind to a target antigen, using routine methods available in the art, including those described herein. In particular embodiments, culture supernatants are tested for the presence of antibodies that bind to a target antigen using high-throughput methods. For example, B cells may be cultured in multi-well microtitre dishes, such that robotic plate handlers may be used to simultaneously sample multiple cell supernatants and test for the presence of antibodies that bind to a target antigen. In particular embodiments, antigens are bound to beads, e.g., paramagnetic or latex beads) to facilitate the capture of antibody/antigen complexes. In other embodiments, antigens and antibodies are fluorescently labeled (with different labels) and FACS analysis is performed to identify the presence of antibodies that bind to target antigen. In one embodiment, antibody binding is determined using FMAT™ analysis and instrumentation (Applied Biosystems, Foster City, Calif.). FMAT™ is a fluorescence macro-confocal platform for high-throughput screening, which mix-and-read, non-radioactive assays using live cells or beads.

In the context of comparing the binding of an antibody to a particular target antigen (e.g., a biological sample such as infected tissue or cells, or infectious agents) as compared to a control sample (e.g., a biological sample such as uninfected cells, or a different infectious agent), in various embodiments, the antibody is considered to preferentially bind a particular target antigen if at least two-fold, at least three-fold, at least five-fold, or at least ten-fold more antibody binds to the particular target antigen as compared to the amount that binds a control sample.

Polynucleotides encoding antibody chains, variable regions thereof, or fragments thereof, may be isolated from cells utilizing any means available in the art. In one embodiment, polynucleotides are isolated using polymerase chain reaction (PCR), e.g., reverse transcription-PCR (RT-PCR) using oligonucleotide primers that specifically bind to heavy or light chain encoding polynucleotide sequences or complements thereof using routine procedures available in the art. In one embodiment, positive wells are subjected to whole well RT-PCR to amplify the heavy and light chain variable regions of the IgG molecule expressed by the clonal daughter plasma cells. These PCR products may be sequenced.

The resulting PCR products encoding the heavy and light chain variable regions or portions thereof are then subcloned into human antibody expression vectors and recombinantly expressed according to routine procedures in the art (see, e.g., U.S. Pat. No. 7,112,439). The nucleic acid molecules encoding a tumor-specific antibody or fragment thereof, as described herein, may be propagated and expressed according to any of a variety of well-known procedures for nucleic acid excision, ligation, transformation, and transfection. Thus, in certain embodiments expression of an antibody fragment may be preferred in a prokaryotic host cell, such as *Escherichia coli* (see, e.g., Pluckthun et al., *Methods Enzymol.* 178:497-515 (1989)). In certain other embodiments, expression of the antibody or an antigen-binding fragment thereof may be preferred in a eukaryotic host cell, including yeast (e.g., *Saccharomyces cerevisiae, Schizosaccharomyces pombe,* and *Pichia pastoris*); animal cells (including mammalian cells); or plant cells. Examples of suitable animal cells include, but are not limited to, myeloma, COS, CHO, or hybridoma cells. Examples of plant cells include tobacco, corn, soybean, and rice cells. By methods known to those having ordinary skill in the art and based on the present disclosure, a nucleic acid vector may be designed for expressing foreign sequences in a particular host system, and then polynucleotide sequences encoding the tumor-specific antibody (or fragment thereof) may be inserted. The regulatory elements will vary according to the particular host.

One or more replicable expression vectors containing a polynucleotide encoding a variable and/or constant region may be prepared and used to transform an appropriate cell line, for example, a non-producing myeloma cell line, such as a mouse NSO line or a bacterium, such as *E. coli,* in which production of the antibody will occur. In order to obtain efficient transcription and translation, the polynucleotide sequence in each vector should include appropriate regulatory sequences, particularly a promoter and leader sequence operatively linked to the variable domain sequence. Particular methods for producing antibodies in this way are generally well known and routinely used. For example, molecular biology procedures are described by Sambrook et al. (*Molecular Cloning, A Laboratory Manual,* 2nd ed., Cold Spring Harbor Laboratory, New York, 1989; see also Sambrook et al., 3rd ed., Cold Spring Harbor Laboratory, New York, (2001)). While not required, in certain embodiments, regions of polynucleotides encoding the recombinant antibodies may be sequenced. DNA sequencing can be performed as described in Sanger et al. (*Proc. Natl. Acad. Sci. USA* 74:5463 (1977)) and the Amersham International plc sequencing handbook and including improvements thereto.

In particular embodiments, the resulting recombinant antibodies or fragments thereof are then tested to confirm their original specificity and may be further tested for pan-specificity, e.g., with related infectious agents. In particular embodiments, an antibody identified or produced according to methods described herein is tested for cell killing via antibody dependent cellular cytotoxicity (ADCC) or apoptosis, and/or well as its ability to internalize.

Polynucleotides

The present invention, in other aspects, provides polynucleotide compositions. In preferred embodiments, these polynucleotides encode a polypeptide of the invention, e.g., a region of a variable chain of an antibody that binds to Influenza A, M2, M2e, or HA (soluble or recombinant). Polynucleotides of the invention are single-stranded (coding or antisense) or double-stranded DNA (genomic, cDNA or synthetic) or RNA molecules. RNA molecules include, but are not limited to, HnRNA molecules, which contain introns and correspond to a DNA molecule in a one-to-one manner, and mRNA molecules, which do not contain introns. Alternatively, or in addition, coding or non-coding sequences are present within a polynucleotide of the present invention. Also alternatively, or in addition, a polynucleotide is linked to other molecules and/or support materials of the invention.

Polynucleotides of the invention are used, e.g., in hybridization assays to detect the presence of an Influenza A antibody in a biological sample, and in the recombinant production of polypeptides of the invention.

Therefore, according to another aspect of the present invention, polynucleotide compositions are provided that include some or all of a polynucleotide sequences set forth herein, complements of these polynucleotide sequences, and degenerate variants of these polynucleotide sequences. In certain preferred embodiments, the polynucleotide sequences set forth herein encode polypeptides capable of preferentially binding a Influenza A-infected cell as compared to a normal control uninfected cell, including a polypeptide having a sequence set forth herein. Furthermore, the invention includes all polynucleotides that encode any polypeptide of the present invention.

In other related embodiments, the invention provides polynucleotide variants having substantial identity to the sequences set forth herein, for example those comprising at least 70% sequence identity, preferably at least 75%, 80%, 85%, 90%, 95%, 96%, 97%, 98%, or 99% or higher, sequence identity compared to a polynucleotide sequence of this invention, as determined using the methods described herein, (e.g., BLAST analysis using standard parameters). One skilled in this art will recognize that these values can be appropriately adjusted to determine corresponding identity of proteins encoded by two nucleotide sequences by taking into account codon degeneracy, amino acid similarity, reading frame positioning, and the like.

Typically, polynucleotide variants contain one or more substitutions, additions, deletions and/or insertions, preferably such that the immunogenic binding properties of the polypeptide encoded by the variant polynucleotide is not substantially diminished relative to a polypeptide encoded by a polynucleotide sequence specifically set forth herein. In additional embodiments, the present invention provides polynucleotide fragments comprising various lengths of contiguous stretches of sequence identical to or complementary to one or more of the sequences disclosed herein. For example, polynucleotides are provided by this invention that comprise at least about 10, 15, 20, 30, 40, 50, 75, 100, 150, 200, 300, 400, 500 or 1000 or more contiguous nucleotides of one or more of the sequences disclosed herein as well as all intermediate lengths there between. As used herein, the term "intermediate lengths" is meant to describe any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; including all integers through 200-500; 500-1,000, and the like.

In another embodiment of the invention, polynucleotide compositions are provided that are capable of hybridizing under moderate to high stringency conditions to a polynucleotide sequence provided herein, or a fragment thereof, or a complementary sequence thereof. Hybridization techniques are well known in the art of molecular biology. For purposes of illustration, suitable moderately stringent conditions for testing the hybridization of a polynucleotide of this invention with other polynucleotides include prewashing in a solution of 5×SSC, 0.5% SDS, 1.0 mM EDTA (pH 8.0); hybridizing at 50° C.-60° C., 5×SSC, overnight; followed by washing twice at 65° C. for 20 minutes with each of 2×, 0.5× and 0.2×SSC containing 0.1% SDS. One skilled in the art will understand that the stringency of hybridization can be readily manipulated, such as by altering the salt content of the hybridization solution and/or the temperature at which the hybridization is performed. For example, in another embodiment, suitable highly stringent hybridization conditions include those described above, with the exception that the temperature of hybridization is increased, e.g., to 60-65° C. or 65-70° C.

In preferred embodiments, the polypeptide encoded by the polynucleotide variant or fragment has the same binding specificity (i.e., specifically or preferentially binds to the same epitope or Influenza A strain) as the polypeptide encoded by the native polynucleotide. In certain preferred embodiments, the polynucleotides described above, e.g., polynucleotide variants, fragments and hybridizing sequences, encode polypeptides that have a level of binding activity of at least about 50%, preferably at least about 70%, and more preferably at least about 90% of that for a polypeptide sequence specifically set forth herein.

The polynucleotides of the present invention, or fragments thereof, regardless of the length of the coding sequence itself, may be combined with other DNA sequences, such as promoters, polyadenylation signals, additional restriction enzyme sites, multiple cloning sites, other coding segments, and the like, such that their overall length may vary considerably. A nucleic acid fragment of almost any length is employed, with the total length preferably being limited by the ease of preparation and use in the intended recombinant DNA protocol. For example, illustrative polynucleotide segments with total lengths of about 10,000, about 5000, about 3000, about 2,000, about 1,000, about 500, about 200, about 100, about 50 base pairs in length, and the like, (including all intermediate lengths) are included in many implementations of this invention.

It will be appreciated by those of ordinary skill in the art that, as a result of the degeneracy of the genetic code, there are multiple nucleotide sequences that encode a polypeptide as described herein. Some of these polynucleotides bear minimal homology to the nucleotide sequence of any native gene. Nonetheless, polynucleotides that encode a polypeptide of the present invention but which vary due to differences in codon usage are specifically contemplated by the invention. Further, alleles of the genes including the polynucleotide sequences provided herein are within the scope of the invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

In certain embodiments of the present invention, mutagenesis of the disclosed polynucleotide sequences is performed in order to alter one or more properties of the encoded polypeptide, such as its binding specificity or binding strength. Techniques for mutagenesis are well-known in the art, and are widely used to create variants of both polypeptides and polynucleotides. A mutagenesis approach, such as site-specific mutagenesis, is employed for the preparation of variants and/or derivatives of the polypeptides described herein. By this approach, specific modifications in a polypeptide sequence are made through mutagenesis of the underlying polynucleotides that encode them. These techniques provides a straightforward approach to prepare and test sequence variants, for example, incorporating one or more of the foregoing considerations, by introducing one or more nucleotide sequence changes into the polynucleotide.

Site-specific mutagenesis allows the production of mutants through the use of specific oligonucleotide sequences include the nucleotide sequence of the desired mutation, as well as a sufficient number of adjacent nucleotides, to provide a primer sequence of sufficient size and sequence complexity to form a stable duplex on both sides of the deletion junction being traversed. Mutations are employed in a selected polynucleotide sequence to improve, alter, decrease, modify, or otherwise change the properties of the polynucleotide itself, and/or alter the properties, activity; composition, stability, or primary sequence of the encoded polypeptide.

In other embodiments of the present invention, the polynucleotide sequences provided herein are used as probes or primers for nucleic acid hybridization, e.g., as PCR primers. The ability of such nucleic acid probes to specifically hybridize to a sequence of interest enable them to detect the presence of complementary sequences in a given sample. However, other uses are also encompassed by the invention, such as the use of the sequence information for the preparation of mutant species primers, or primers for use in preparing other genetic constructions. As such, nucleic acid segments of the invention that include a sequence region of at least about 15 nucleotides long contiguous sequence that has the same sequence as, or is complementary to, a 15 nucleotide long contiguous sequence disclosed herein is particularly useful. Longer contiguous identical or complementary sequences, e.g., those of about 20, 30, 40, 50, 100, 200, 500, 1000 (including all intermediate lengths) including full length sequences, and all lengths in between, are also used in certain embodiments.

Polynucleotide molecules having sequence regions consisting of contiguous nucleotide stretches of 10-14, 15-20, 30, 50, or even of 100-200 nucleotides or so (including intermediate lengths as well), identical or complementary to a polynucleotide sequence disclosed herein, are particularly contemplated as hybridization probes for use in, e.g., Southern and Northern blotting, and/or primers for use in, e.g., polymerase chain reaction (PCR). The total size of fragment, as well as the size of the complementary stretch(es), ultimately depends on the intended use or application of the particular nucleic acid segment. Smaller fragments are generally used in hybridization embodiments, wherein the length of the contiguous complementary region may be varied, such as between about 15 and about 100 nucleotides, but larger contiguous complementarity stretches may be used, according to the length complementary sequences one wishes to detect.

The use of a hybridization probe of about 15-25 nucleotides in length allows the formation of a duplex molecule that is both stable and selective. Molecules having contiguous complementary sequences over stretches greater than 12 bases in length are generally preferred, though, in order to increase stability and selectivity of the hybrid, and thereby improve the quality and degree of specific hybrid molecules obtained. Nucleic acid molecules having gene-complementary stretches of 15 to 25 contiguous nucleotides, or even longer where desired, are generally preferred.

Hybridization probes are selected from any portion of any of the sequences disclosed herein. All that is required is to review the sequences set forth herein, or to any continuous portion of the sequences, from about 15-25 nucleotides in length up to and including the full length sequence, that one wishes to utilize as a probe or primer. The choice of probe and primer sequences is governed by various factors. For example, one may wish to employ primers from towards the termini of the total sequence.

Polynucleotide of the present invention, or fragments or variants thereof, are readily prepared by, for example, directly synthesizing the fragment by chemical means, as is commonly practiced using an automated oligonucleotide synthesizer. Also, fragments are obtained by application of nucleic acid reproduction technology, such as the PCR™ technology of U.S. Pat. No. 4,683,202, by introducing selected sequences into recombinant vectors for recombinant production, and by other recombinant DNA techniques generally known to those of skill in the art of molecular biology.

Vectors, Host Cells and Recombinant Methods

The invention provides vectors and host cells comprising a nucleic acid of the present invention, as well as recombinant techniques for the production of a polypeptide of the present invention. Vectors of the invention include those capable of replication in any type of cell or organism, including, e.g., plasmids, phage, cosmids, and mini chromosomes. In various embodiments, vectors comprising a polynucleotide of the present invention are vectors suitable for propagation or replication of the polynucleotide, or vectors suitable for expressing a polypeptide of the present invention. Such vectors are known in the art and commercially available.

Polynucleotides of the present invention are synthesized, whole or in parts that are then combined, and inserted into a vector using routine molecular and cell biology techniques, including, e.g., subcloning the polynucleotide into a linearized vector using appropriate restriction sites and restriction enzymes. Polynucleotides of the present invention are amplified by polymerase chain reaction using oligonucleotide primers complementary to each strand of the polynucleotide. These primers also include restriction enzyme cleavage sites to facilitate subcloning into a vector. The replicable vector components generally include, but are not limited to, one or more of the following: a signal sequence, an origin of replication, and one or more marker or selectable genes.

In order to express a polypeptide of the present invention, the nucleotide sequences encoding the polypeptide, or functional equivalents, are inserted into an appropriate expression vector, i.e., a vector that contains the necessary elements for the transcription and translation of the inserted coding sequence. Methods well known to those skilled in the art are used to construct expression vectors containing sequences encoding a polypeptide of interest and appropriate transcriptional and translational control elements. These methods include in vitro recombinant DNA techniques, synthetic techniques, and in vivo genetic recombination. Such techniques are described, for example, in Sambrook, J., et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y.

A variety of expression vector/host systems are utilized to contain and express polynucleotide sequences. These include, but are not limited to, microorganisms such as bacteria transformed with recombinant bacteriophage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems. Within one embodiment, the variable regions of a gene expressing a monoclonal antibody of interest are amplified from a hybridoma cell using nucleotide primers. These primers are synthesized by one of ordinary skill in the art, or may be purchased from commercially available sources (see, e.g., Stratagene (La Jolla, Calif.), which sells primers for amplifying mouse and human variable regions. The primers are used to amplify heavy or light chain variable regions, which are then inserted into vectors such as ImmunoZAP™ H or ImmunoZAP™ L (Stratagene), respectively. These vectors are then introduced into *E. coli,* yeast, or mammalian-based systems for expression. Large amounts of a single-chain protein containing a fusion of the $V_H$ and $V_L$ domains are produced using these methods (see Bird et al., *Science* 242:423-426 (1988)).

The "control elements" or "regulatory sequences" present in an expression vector are those non-translated regions of the vector, e.g., enhancers, promoters, 5' and 3' untranslated regions, that interact with host cellular proteins to carry out transcription and translation. Such elements may vary in their strength and specificity. Depending on the vector system and host utilized, any number of suitable transcription and translation elements, including constitutive and inducible promoters, is used.

Examples of promoters suitable for use with prokaryotic hosts include the phoa promoter, β-lactamase and lactose promoter systems, alkaline phosphatase promoter, a tryptophan (trp) promoter system, and hybrid promoters such as the tac promoter. However, other known bacterial promoters are suitable. Promoters for use in bacterial systems also usually contain a Shine-Dalgarno sequence operably linked to the DNA encoding the polypeptide. Inducible promoters such as the hybrid lacZ promoter of the PBLUESCRIPT phagemid (Stratagene, La Jolla, Calif.) or PSPORT1 plasmid (Gibco BRL, Gaithersburg, Md.) and the like are used.

A variety of promoter sequences are known for eukaryotes and any are used according to the present invention. Virtually all eukaryotic genes have an AT-rich region located approximately 25 to 30 bases upstream from the site where transcription is initiated. Another sequence found 70 to 80 bases upstream from the start of transcription of many genes is a CNCAAT region where N may be any nucleotide. At the 3' end of most eukaryotic genes is an AATAAA sequence that may be the signal for addition of the poly A tail to the 3' end of the coding sequence. All of these sequences are suitably inserted into eukaryotic expression vectors.

In mammalian cell systems, promoters from mammalian genes or from mammalian viruses are generally preferred. Polypeptide expression from vectors in mammalian host cells aer controlled, for example, by promoters obtained from the genomes of viruses such as polyoma virus, fowlpox virus, adenovirus (e.g., Adenovirus 2), bovine papilloma virus, avian sarcoma virus, cytomegalovirus (CMV), a retrovirus, hepatitis-B virus and most preferably Simian Virus 40 (SV40), from heterologous mammalian promoters, e.g., the actin promoter or an immunoglobulin promoter, and from heat-shock promoters, provided such promoters are compatible with the host cell systems. If it is necessary to generate a cell line that contains multiple copies of the sequence encoding a polypeptide, vectors based on SV40 or EBV may be advantageously used with an appropriate selectable marker. One example of a suitable expression vector is pcDNA-3.1 (Invitrogen, Carlsbad, Calif.), which includes a CMV promoter.

A number of viral-based expression systems are available for mammalian expression of polypeptides. For example, in cases where an adenovirus is used as an expression vector, sequences encoding a polypeptide of interest may be ligated into an adenovirus transcription/translation complex consisting of the late promoter and tripartite leader sequence. Insertion in a non-essential E1 or E3 region of the viral genome may be used to obtain a viable virus that is capable of expressing the polypeptide in infected host cells (Logan, J. and Shenk, T. (1984) Proc. Natl. Acad. Sci. 81:3655-3659). In addition, transcription enhancers, such as the Rous sarcoma virus (RSV) enhancer, may be used to increase expression in mammalian host cells.

In bacterial systems, any of a number of expression vectors are selected depending upon the use intended for the expressed polypeptide. For example, when large quantities are desired, vectors that direct high level expression of fusion proteins that are readily purified are used. Such vectors include, but are not limited to, the multifunctional *E. coli* cloning and expression vectors such as BLUESCRIPT (Stratagene), in which the sequence encoding the polypeptide of interest may be ligated into the vector in frame with sequences for the amino-terminal Met and the subsequent 7 residues of β-galactosidase, so that a hybrid protein is produced; pIN vectors (Van Heeke, G. and S. M. Schuster (1989) J. Biol. Chem. 264:5503-5509); and the like. pGEX Vectors (Promega, Madison, Wis.) are also used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems are designed to include heparin, thrombin, or factor XA protease cleavage sites so that the cloned polypeptide of interest can be released from the GST moiety at will.

In the yeast, Saccharomyces cerevisiae, a number of vectors containing constitutive or inducible promoters such as alpha factor, alcohol oxidase, and PGH are used. Examples of other suitable promoter sequences for use with yeast hosts include the promoters for 3-phosphoglycerate kinase or other glycolytic enzymes, such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase. For reviews, see Ausubel et al. (supra) and Grant et al. (1987) Methods Enzymol. 153:516-544. Other yeast promoters that are inducible promoters having the additional advantage of transcription controlled by growth conditions include the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657. Yeast enhancers also are advantageously used with yeast promoters.

In cases where plant expression vectors are used, the expression of sequences encoding polypeptides are driven by any of a number of promoters. For example, viral promoters such as the 35S and 19S promoters of CaMV are used alone or in combination with the omega leader sequence from TMV (Takamatsu, N. (1987) EMBO J. 6:307-311. Alternatively, plant promoters such as the small subunit of RUBISCO or heat shock promoters are used (Coruzzi, G. et al. (1984) EMBO J. 3:1671-1680; Broglie, R. et al. (1984) Science 224:838-843; and Winter, J., et al. (1991) Results Probl. Cell Differ. 17:85-105). These constructs can be introduced into plant cells by direct DNA transformation or pathogen-mediated transfection. Such techniques are described in a number of generally available reviews (see, e.g., Hobbs, S. or Murry, L. E. in McGraw Hill Yearbook of Science and Technology (1992) McGraw Hill, New York, N.Y.; pp. 191-196).

An insect system is also used to express a polypeptide of interest. For example, in one such system, *Autographa californica* nuclear polyhedrosis virus (AcNPV) is used as a vector to express foreign genes in *Spodoptera frugiperda* cells or in *Trichoplusia* larvae. The sequences encoding the polypeptide are cloned into a non-essential region of the virus, such as the polyhedrin gene, and placed under control of the polyhedrin promoter. Successful insertion of the polypeptide-encoding sequence renders the polyhedrin gene inactive and produce recombinant virus lacking coat protein. The recombinant viruses are then used to infect, for example, *S. frugiperda* cells or *Trichoplusia* larvae, in which the polypeptide of interest is expressed (Engelhard, E. K. et al. (1994) Proc. Natl. Acad. Sci. 91 :3224-3227).

Specific initiation signals are also used to achieve more efficient translation of sequences encoding a polypeptide of interest. Such signals include the ATG initiation codon and adjacent sequences. In cases where sequences encoding the polypeptide, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon are provided. Furthermore, the initiation codon is in the correct reading frame to ensure correct translation of the inserted polynucleotide. Exogenous translational elements and initiation codons are of various origins, both natural and synthetic.

Transcription of a DNA encoding a polypeptide of the invention is often increased by inserting an enhancer sequence into the vector. Many enhancer sequences are known, including, e.g., those identified in genes encoding globin, elastase, albumin, α-fetoprotein, and insulin. Typically, however, an enhancer from a eukaryotic cell virus is used. Examples include the SV40 enhancer on the late side of the replication origin (bp 100-270), the cytomegalovirus early promoter enhancer, the polyoma enhancer on the late side of the replication origin, and adenovirus enhancers. See also Yaniv, Nature 297:17-18 (1982) on enhancing elements for activation of eukaryotic promoters. The enhancer is spliced into the vector at a position 5' or 3' to the polypeptide-encoding sequence, but is preferably located at a site 5' from the promoter.

Expression vectors used in eukaryotic host cells (yeast, fungi, insect, plant, animal, human, or nucleated cells from other multicellular organisms) typically also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding anti-PSCA antibody. One useful transcription termination component is the bovine growth hormone polyadenylation region. See WO94/11026 and the expression vector disclosed therein.

Suitable host cells for cloning or expressing the DNA in the vectors herein are the prokaryote, yeast, plant or higher eukaryote cells described above. Examples of suitable prokaryotes for this purpose include eubacteria, such as Gram-negative or Gram-positive organisms, for example, Enterobacteriaceae such as *Escherichia*, e.g., *E. coli, Enterobacter, Erwinia, Klebsiella, Proteus, Salmonella*, e.g., *Salmonella typhimurium, Serratia*, e.g., *Serratia marcescans*, and *Shigella*, as well as *Bacilli* such as *B. subtilis* and *B. licheniformis* (e.g., *B. licheniformis* 41P disclosed in DD 266,710 published 12 Apr. 1989), *Pseudomonas* such as *P. aeruginosa*, and *Streptomyces*. One preferred *E. coli* cloning host is *E. coli* 294 (ATCC 31,446), although other strains such as *E. coli* B, *E. coli* X1776 (ATCC 31,537), and *E. coli* W3110 (ATCC 27,325) are suitable. These examples are illustrative rather than limiting.

*Saccharomyces cerevisiae,* or common baker's yeast, is the most commonly used among lower eukaryotic host microorganisms. However, a number of other genera, species, and strains are commonly available and used herein, such as Schizosaccharomyces pombe; Kluyveromyces hosts such as, e.g., K lactis, K. fragilis (ATCC 12,424), K bulgaricus (ATCC 16,045), K wickeramii (ATCC 24,178), K. waltii (ATCC 56,500), K. drosophilarum (ATCC 36,906), K. thermotolerans, and K. marxianus; yarrowia (EP 402,226); Pichia pastoris. (EP 183,070); Candida; Trichoderma reesia (EP 244, 234); Neurospora crassa; Schwanniomyces such as Schwanniomyces occidentalis; and filamentous fungi such as, e.g., Neurospora, Penicillium, Tolypocladium, and Aspergillus hosts such as A. nidulans and A. niger.

In certain embodiments, a host cell strain is chosen for its ability to modulate the expression of the inserted sequences or to process the expressed protein in the desired fashion. Such modifications of the polypeptide include, but are not limited to, acetylation, carboxylation. glycosylation, phosphorylation, lipidation, and acylation. Post-translational processing that cleaves a "prepro" form of the protein is also used to facilitate correct insertion, folding and/or function. Different host cells such as CHO, COS, HeLa, MDCK, HEK293, and WI38, which have specific cellular machinery and characteristic mechanisms for such post-translational activities, are chosen to ensure the correct modification and processing of the foreign protein.

Methods and reagents specifically adapted for the expression of antibodies or fragments thereof are also known and available in the art, including those described, e.g., in U.S. Pat. Nos. 4,816,567 and 6,331,415. In various embodiments, antibody heavy and light chains, or fragments thereof, are expressed from the same or separate expression vectors. In one embodiment, both chains are expressed in the same cell, thereby facilitating the formation of a functional antibody or fragment thereof.

Full length antibody, antibody fragments, and antibody fusion proteins are produced in bacteria, in particular when glycosylation and Fc effector function are not needed, such as when the therapeutic antibody is conjugated to a cytotoxic agent (e.g., a toxin) and the immunoconjugate by itself shows effectiveness in infected cell destruction. For expression of antibody fragments and polypeptides in bacteria, see, e.g., U.S. Pat. Nos. 5,648,237, 5,789,199, and 5,840,523, which describes translation initiation region (TIR) and signal sequences for optimizing expression and secretion. After expression, the antibody is isolated from the E. coli cell paste in a soluble fraction and can be purified through, e.g., a protein A or G column depending on the isotype. Final purification can be carried out using a process similar to that used for purifying antibody expressed e.g., in CHO cells.

Suitable host cells for the expression of glycosylated polypeptides and antibodies are derived from multicellular organisms. Examples of invertebrate cells include plant and insect cells. Numerous baculoviral strains and variants and corresponding permissive insect host cells from hosts such as Spodoptera frugiperda (caterpillar), Aedes aegypti (mosquito), Aedes albopicius (mosquito), Drosophila melanogaster (fruitfly), and Bombyx mori have been identified. A variety of viral strains for transfection are publicly available, e.g., the L-1 variant of Autographa californica NPV and the Bm-5 strain of Bombyx mori NPV, and such viruses are used as the virus herein according to the present invention, particularly for transfection of Spodoptera frugiperda cells. Plant cell cultures of cotton, corn, potato, soybean, petunia, tomato, and tobacco are also utilized as hosts.

Methods of propagation of antibody polypeptides and fragments thereof in vertebrate cells in culture (tissue culture) are encompassed by the invention. Examples of mammalian host cell lines used in the methods of the invention are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/-DHFR (CHO, Urlaub et al., Proc. Natl. Acad. Sci. USA 77:4216 (1980)); mouse sertoli cells (TM4, Mather, Biol. Reprod. 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TR1 cells (Mather et al., Annals N.Y. Acad. Sci. 383:44-68 (1982)); MRC 5 cells; FS4 cells; and a human hepatoma line (Hep G2).

Host cells are transformed with the above-described expression or cloning vectors for polypeptide production and cultured in conventional nutrient media modified as appropriate for inducing promoters, selecting transformants, or amplifying the genes encoding the desired sequences.

For long-term, high-yield production of recombinant proteins, stable expression is generally preferred. For example, cell lines that stably express a polynucleotide of interest are transformed using expression vectors that contain viral origins of replication and/or endogenous expression elements and a selectable marker gene on the same or on a separate vector. Following the introduction of the vector, cells are allowed to grow for 1-2 days in an enriched media before they are switched to selective media. The purpose of the selectable marker is to confer resistance to selection, and its presence allows growth and recovery of cells that successfully express the introduced sequences. Resistant clones of stably transformed cells are proliferated using tissue culture techniques appropriate to the cell type.

A plurality of selection systems are used to recover transformed cell lines. These include, but are not limited to, the herpes simplex virus thymidine kinase (Wigler, M. et al. (1977) Cell 11:223-32) and adenine phosphoribosyltransferase (Lowy, I. et al. (1990) Cell 22:817-23) genes that are employed in tk$^-$ or aprt$^-$ cells, respectively. Also, antimetabolite, antibiotic or herbicide resistance is used as the basis for selection; for example, dhfr, which confers resistance to methotrexate (Wigler, M. et al. (1980) Proc. Natl. Acad. Sci. 77:3567-70); npt, which confers resistance to the aminoglycosides, neomycin and G-418 (Colbere-Garapin, F. et al. (1981) J. Mol. Biol. 150:1-14); and als or pat, which confer resistance to chlorsulfuron and phosphinotricin acetyltransferase, respectively (Murry, supra). Additional selectable genes have been described. For example, trpB allows cells to utilize indole in place of tryptophan, and hisD allows cells to utilize histinol in place of histidine (Hartman, S. C. and R. C. Mulligan (1988) Proc. Natl. Acad. Sci. 85:8047-51). The use of visible markers has gained popularity with such markers as anthocyanins, beta-glucuronidase and its substrate GUS, and luciferase and its substrate luciferin, being widely used not only to identify transformants, but also to quantify the amount of transient or stable protein expression attributable to a specific vector system (Rhodes, C. A. et al. (1995) Methods Mol. Biol. 55:121-131).

Although the presence/absence of marker gene expression suggests that the gene of interest is also present, its presence and expression is confirmed. For example, if the sequence encoding a polypeptide is inserted within a marker gene sequence, recombinant cells containing sequences are identified by the absence of marker gene function. Alternatively, a marker gene is placed in tandem with a polypeptide-encoding sequence under the control of a single promoter. Expression of the marker gene in response to induction or selection usually indicates expression of the tandem gene as well.

Alternatively, host cells that contain and express a desired polynucleotide sequence are identified by a variety of procedures known to those of skill in the art. These procedures include, but are not limited to, DNA-DNA or DNA-RNA hybridizations and protein bioassay or immunoassay techniques which include, for example, membrane, solution, or chip based technologies for the detection and/or quantification of nucleic acid or protein.

A variety of protocols for detecting and measuring the expression of polynucleotide-encoded products, using either polyclonal or monoclonal antibodies specific for the product are known in the art. Nonlimiting examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on a given polypeptide is preferred for some applications, but a competitive binding assay may also be employed. These and other assays are described, among other places, in Hampton, R. et al. (1990; Serological Methods, a Laboratory Manual, APS Press, St Paul. Minn.) and Maddox, D. E. et al. (1983; J. Exp. Med. 158:1211-1216).

Various labels and conjugation techniques are known by those skilled in the art and are used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences, or any portions thereof are cloned into a vector for the production of an mRNA probe. Such vectors are known in the art, are commercially available, and are used to synthesize RNA probes in vitro by addition of an appropriate RNA polymerase such as T7, T3, or SP6 and labeled nucleotides. These procedures are conducted using a variety of commercially available kits. Suitable reporter molecules or labels, which are used include, but are not limited to, radionuclides, enzymes, fluorescent, chemiluminescent, or chromogenic agents as well as substrates, cofactors, inhibitors, magnetic particles, and the like.

The polypeptide produced by a recombinant cell is secreted or contained intracellularly depending on the sequence and/or the vector used. Expression vectors containing polynucleotides of the invention are designed to contain signal sequences that direct secretion of the encoded polypeptide through a prokaryotic or eukaryotic cell membrane.

In certain embodiments, a polypeptide of the invention is produced as a fusion polypeptide further including a polypeptide domain that facilitates purification of soluble proteins. Such purification-facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Amgen, Seattle, Wash.). The inclusion of cleavable linker sequences such as those specific for Factor XA or enterokinase (Invitrogen. San Diego, Calif.) between the purification domain and the encoded polypeptide are used to facilitate purification. An exemplary expression vector provides for expression of a fusion protein containing a polypeptide of interest and a nucleic acid encoding 6 histidine residues preceding a thioredoxin or an enterokinase cleavage site. The histidine residues facilitate purification on IMIAC (immobilized metal ion affinity chromatography) as described in Porath, J. et al. (1992, Prot. Exp. Purif. 3:263-281) while the enterokinase cleavage site provides a means for purifying the desired polypeptide from the fusion protein. A discussion of vectors used for producing fusion proteins is provided in Kroll, D. J. et al. (1993; DNA Cell Biol. 12:441-453).

In certain embodiments, a polypeptide of the present invention is fused with a heterologous polypeptide, which may be a signal sequence or other polypeptide having a specific cleavage site at the N-terminus of the mature protein or polypeptide. The heterologous signal sequence selected preferably is one that is recognized and processed (i.e., cleaved by a signal peptidase) by the host cell. For prokaryotic host cells, the signal sequence is selected, for example, from the group of the alkaline phosphatase, penicillinase, 1pp, or heat-stable enterotoxin II leaders. For yeast secretion, the signal sequence is selected from, e.g., the yeast invertase leader, α factor leader (including Saccharomyces and Kluyveromyces α factor leaders), or acid phosphatase leader, the C. albicans glucoamylase leader, or the signal described in WO 90/13646. In mammalian cell expression, mammalian signal sequences as well as viral secretory leaders, for example, the herpes simplex gD signal, are available.

When using recombinant techniques, the polypeptide or antibody is produced intracellularly, in the periplasmic space, or directly secreted into the medium. If the polypeptide or antibody is produced intracellularly, as a first step, the particulate debris, either host cells or lysed fragments, are removed, for example, by centrifugation or ultrafiltration. Carter et al., Bio/Technology 10:163-167 (1992) describe a procedure for isolating antibodies that are secreted to the periplasmic space of E. coli. Briefly, cell paste is thawed in the presence of sodium acetate (pH 3.5), EDTA, and phenylmethylsulfonylfluoride (PMSF) over about 30 min. Cell debris is removed by centrifugation. Where the polypeptide or antibody is secreted into the medium, supernatants from such expression systems are generally first concentrated using a commercially available protein concentration filter, for example, an Amicon or Millipore Pellicon ultrafiltration unit. Optionally, a protease inhibitor such as PMSF is included in any of the foregoing steps to inhibit proteolysis and antibiotics are included to prevent the growth of adventitious contaminants.

The polypeptide or antibody composition prepared from the cells are purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the polypeptide or antibody. Protein A is used to purify antibodies or fragments thereof that are based on human $\gamma_1$, $\gamma_2$, or $\gamma_4$ heavy chains (Lindmark et al., J. Immunol. Meth. 62:1-13 (1983)). Protein G is recommended for all mouse isotypes and for human $\gamma_3$ (Guss et al., EMBO J. 5:15671575 (1986)). The matrix to which the affinity ligand is attached is most often agarose, but other matrices are available. Mechanically stable matrices such as controlled pore glass or poly(styrenedivinyl) benzene allow for faster flow rates and shorter processing times than can be achieved with agarose. Where the polypeptide or antibody comprises a $C_H3$ domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the polypeptide or antibody to be recovered.

Following any preliminary purification step(s), the mixture comprising the polypeptide or antibody of interest and contaminants are subjected to low pH hydrophobic interaction chromatography using an elution buffer at a pH between about 2.5-4.5, preferably performed at low salt concentrations (e.g., from about 0-0.25M salt).

Pharmaceutical Compositions

The invention further includes pharmaceutical formulations including a polypeptide, antibody, or modulator of the present invention, at a desired degree of purity, and a pharmaceutically acceptable carrier, excipient, or stabilizer (Remingion's Pharmaceutical Sciences 16th edition, Osol, A. Ed. (1980)). In certain embodiments, pharmaceutical formulations are prepared to enhance the stability of the polypeptide or antibody during storage, e.g., in the form of lyophilized formulations or aqueous solutions.

Acceptable carriers, excipients, or stabilizers are nontoxic to recipients at the dosages and concentrations employed, and include, e.g., buffers such as acetate, Tris, phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; tonicifiers such as trehalose and sodium chloride; sugars such as sucrose, mannitol, trehalose or sorbitol; surfactant such as polysorbate; salt-forming counter-ions such as sodium; metal complexes (e.g. Zn-protein complexes); and/or non-ionic surfactants such as TWEEN™, PLURONICS™ or polyethylene glycol (PEG). In certain embodiments, the therapeutic formulation preferably comprises the polypeptide or antibody at a concentration of between 5-200 mg/ml, preferably between 10-100 mg/ml.

The formulations herein also contain one or more additional therapeutic agents suitable for the treatment of the particular indication, e.g., infection being treated, or to prevent undesired side-effects. Preferably, the additional therapeutic agent has an activity complementary to the polypeptide or antibody of the resent invention, and the two do not adversely affect each other. For example, in addition to the polypeptide or antibody of the invention, an additional or second antibody, anti-viral agent, anti-infective agent and/or cardioprotectant is added to the formulation. Such molecules are suitably present in the pharmaceutical formulation in amounts that are effective for the purpose intended.

The active ingredients, e.g., polypeptides and antibodies of the invention and other therapeutic agents, are also entrapped in microcapsules prepared, for example, by coacervation techniques or by interfacial polymerization, for example, hydroxymethylcellulose or gelatin-microcapsules and polymethylmethacylate) microcapsules, respectively, in colloidal drug delivery systems (for example, liposomes, albumin microspheres, microemulsions, nano-particles and nanocapsules) or in macroemulsions. Such techniques are disclosed in Remingion's Pharmaceutical Sciences 16th edition, Osol, A. Ed. (1980).

Sustained-release preparations are prepared. Suitable examples of sustained-release preparations include, but are not limited to, semi-permeable matrices of solid hydrophobic polymers containing the antibody, which matrices are in the form of shaped articles, e.g., films, or microcapsules. Non-limiting examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxyburyric acid.

Formulations to be used for in vivo administration are preferably sterile. This is readily accomplished by filtration through sterile filtration membranes.

Diagnostic Uses

Antibodies and fragments thereof, and therapeutic compositions, of the invention specifically bind or preferentially bind to infected cells or tissue, as compared to normal control cells and tissue. Thus, these influenza A antibodies are used to detect infected cells or tissues in a patient, biological sample, or cell population, using any of a variety of diagnostic and prognostic methods, including those described herein. The ability of an anti-M2e or anti-HA specific antibody to detect infected cells depends upon its binding specificity, which is readily determined by testing its ability to bind to infected cells or tissues obtained from different patients, and/or from patients infected with different strains of Influenza A.

Diagnostic methods generally involve contacting a biological sample obtained from a patient, such as, e.g., blood, serum, saliva, urine, sputum, a cell swab sample, or a tissue biopsy, with an Influenza A, e.g., human monoclonal anti-M2e or anti-HA antibody, and determining whether the antibody preferentially binds to the sample as compared to a control sample or predetermined cut-off value, thereby indicating the presence of infected cells. In particular embodiments, at least two-fold, three-fold, or five-fold more human monoclonal anti-M2e or anti-HA antibody binds to an infected cell as compared to an appropriate control normal cell or tissue sample. A pre-determined cut-off value is determined, e.g., by averaging the amount of human monoclonal anti-M2e or anti-HA antibody that binds to several different appropriate control samples under the same conditions used to perform the diagnostic assay of the biological sample being tested. Alternatively, or in addition, a hemagglutinin (HA) protein is substituted for an Influenza virus in the above method. The HA protein is presented on the surface of a virus, host cell (e.g. any mammalian cell), or in a recombinant and soluble form. In the HA version of this diagnostic method, the control protein is a denatured HA protein, a linear HA peptide, an unrelated protein of similar size and shape, but dissimilar sequence, or a pre-determined cut-off value.

Bound antibody is detected using procedures described herein and known in the art. In certain embodiments, diagnostic methods of the invention are practiced using human monoclonal anti-M2e or anti-HA antibodies that are conjugated to a detectable label, e.g., a fluorophore, to facilitate detection of bound antibody. However, they are also practiced using methods of secondary detection of the human monoclonal anti-M2e or anti-HA antibody. These include, for example, RIA, ELISA, precipitation, agglutination, complement fixation and immuno-fluorescence.

In certain procedures, the human monoclonal anti-M2e or anti-HA antibodies are labeled. The label is detected directly. Exemplary labels that are detected directly include, but are not limited to, radiolabels and fluorochromes. Alaternatively, or in addition, labels are moieties, such as enzymes, that must be reacted or derivatized to be detected. Nonlimiting examples of isotope labels are $^{99}$Tc, $^{14}$C, $^{131}$I, $^{125}$I, $^{3}$H, $^{32}$P and $^{35}$S. Fluorescent materials that are used include, but are not limited to, for example, fluorescein and its derivatives, rhodamine and its derivatives, auramine, dansyl, umbelliferone, luciferia, 2,3-dihydrophthalazinediones, horseradish peroxidase, alkaline phosphatase, lysozyme, and glucose-6-phosphate dehydrogenase.

An enzyme label is detected by any of the currently utilized colorimetric, spectrophotometric, fluorospectro-photometric or gasometric techniques. Many enzymes which are used in these procedures are known and utilized by the methods of the invention. Nonlimiting examples are peroxidase, alkaline phosphatase, β-glucuronidase, β-D-glucosidase, β-D-galactosidase, urease, glucose oxidase plus peroxidase, galactose oxidase plus peroxidase and acid phosphatase.

The antibodies are tagged with such labels by known methods. For instance, coupling agents such as aldehydes, carbodiimides, dimaleimide, imidates, succinimides, bid-diazotized benzadine and the like are used to tag the antibodies with the above-described fluorescent, chemiluminescent, and enzyme labels. An enzyme is typically combined with an antibody using bridging molecules such as carbodiimides, periodate, diisocyanates, glutaraldehyde and the like. Various labeling techniques are described in Morrison, Methods in Enzymology 32b, 103 (1974), Syvanen et al., J. Biol. Chem. 284, 3762 (1973) and Bolton and Hunter, Biochem J. 133, 529(1973).

Human monoclonal anti-M2e or anti-HA antibodies of the present invention are capable of differentiating between patients with and patients without an Influenza A infection, and determining whether or not a patient has an infection, using the representative assays provided herein. According to one method, a biological sample is obtained from a patient suspected of having or known to have an influenza A infection. In preferred embodiments, the biological sample includes cells from the patient. The sample is contacted with a human monoclonal anti-M2e or anti-HA antibody, e.g., for a time and under conditions sufficient to allow the human monoclonal anti-M2e or anti-HA antibody to bind to infected cells present in the sample. For instance, the sample is contacted with a human monoclonal anti-M2e or anti-HA antibody for 10 seconds, 30 seconds, 1 minute, 5 minutes, 10 minutes, 30 minutes, 1 hour, 6 hours, 12 hours, 24 hours, 3 days or any point in between. The amount of bound human monoclonal anti-M2e or anti-HA antibody is determined and compared to a control value, which may be, e.g., a pre-determined value or a value determined from normal tissue sample. An increased amount of antibody bound to the patient sample as compared to the control sample is indicative of the presence of infected cells in the patient sample.

In a related method, a biological sample obtained from a patient is contacted with a human monoclonal anti-M2e or anti-HA antibody for a time and under conditions sufficient to allow the antibody to bind to infected cells. Bound antibody is then detected, and the presence of bound antibody indicates that the sample contains infected cells. This embodiment is particularly useful when the human monoclonal anti-M2e or anti-HA antibody does not bind normal cells at a detectable level.

Different human monoclonal anti-M2e or anti-HA antibodies possess different binding and specificity characteristics. Depending upon these characteristics, particular human monoclonal anti-M2e or anti-HA antibodies are used to detect the presence of one or more strains of Influenza A. For example, certain antibodies bind specifically to only one or several strains of Influenza virus, whereas others bind to all or a majority of different strains of Influenza virus. Antibodies specific for only one strain of Influenza A are used to identify the strain of an infection.

In certain embodiments, antibodies that bind to an infected cell preferably generate a signal indicating the presence of an infection in at least about 20% of patients with the infection being detected, more preferably at least about 30% of patients. Alternatively, or in addition, the antibody generates a negative signal indicating the absence of the infection in at least about 90% of individuals without the infection being detected. Each antibody satisfies the above criteria; however, antibodies of the present invention are used in combination to improve sensitivity.

The present invention also includes kits useful in performing diagnostic and prognostic assays using the antibodies of the present invention. Kits of the invention include a suitable container comprising a human monoclonal anti-M2e or anti-HA antibody of the invention in either labeled or unlabeled form. In addition, when the antibody is supplied in a labeled form suitable for an indirect binding assay, the kit further includes reagents for performing the appropriate indirect assay. For example, the kit includes one or more suitable containers including enzyme substrates or derivatizing agents, depending on the nature of the label. Control samples and/or instructions are also included.

Therapeutic/Prophylactic Uses

Passive immunization has proven to be an effective and safe strategy for the prevention and treatment of viral diseases. (See Keller et al., Clin. Microbiol. Rev. 13:602-14 (2000); Casadevall, Nat. Biotechnol. 20:114 (2002); Shibata et al., Nat. Med. 5:204-10 (1999); and Igarashi et al., Nat. Med. 5:211-16 (1999), each of which are incorporated herein by reference)). Passive immunization using human monoclonal antibodies provide an immediate treatment strategy for emergency prophylaxis and treatment of influenza Human monoclonal anti-M2e or anti-HA antibodies and fragments thereof, and therapeutic compositions, of the invention specifically bind or preferentially bind to infected cells, as compared to normal control uninfected cells and tissue. Thus, these human monoclonal anti-M2e or anti-HA antibodies are used to selectively target infected cells or tissues in a patient, biological sample, or cell population. In light of the infection-specific binding properties of these antibodies, the present invention provides methods of regulating (e.g., inhibiting) the growth of infected cells, methods of killing infected cells, and methods of inducing apoptosis of infected cells. These methods include contacting an infected cell with a human monoclonal anti-M2e or anti-HA antibody of the invention. These methods are practiced in vitro, ex vivo, and in vivo.

In various embodiments, antibodies of the invention are intrinsically therapeutically active. Alternatively, or in addition, antibodies of the invention are conjugated to a cytotoxic agent or growth inhibitory agent, e.g., a radioisotope or toxin, which is used in treating infected cells bound or contacted by the antibody.

In one embodiment, the invention provides methods of treating or preventing infection in a patient, including the steps of providing a human monoclonal anti-M2e or anti-HA antibody of the invention to a patient diagnosed with, at risk of developing, or suspected of having an Influenza A infection. The methods of the invention are used in the first-line treatment of the infection, follow-on treatment, or in the treatment of a relapsed or refractory infection. Treatment with an antibody of the invention is a stand alone treatment. Alternatively, treatment with an antibody of the invention is one component or phase of a combination therapy regime, in which one or more additional therapeutic agents are also used to treat the patient.

Subjects at risk for an influenza virus -related diseases or disorders include patients who have come into contact with an infected person or who have been exposed to the influenza virus in some other way. Administration of a prophylactic agent can occur prior to the manifestation of symptoms characteristic of the influenza virus-related disease or disorder, such that a disease or disorder is prevented or, alternatively, delayed in its progression.

In various aspects, the human monoclonal anti-M2e or anti-HA is administered substantially contemporaneously with or following infection of the subject, i.e., therapeutic treatment. In another aspect, the antibody provides a therapeutic benefit. In various aspects, a therapeutic benefit includes reducing or decreasing progression, severity, frequency, duration or probability of one or more symptoms or complications of influenza infection, virus titer, virus replication or an amount of a viral protein of one or more influenza strains. still another aspect, a therapeutic benefit includes hastening or accelerating a subject's recovery from influenza infection.

Methods for preventing an increase in influenza virus titer, virus replication, virus proliferation or an amount of an influenza viral protein in a subject are further provided. In one embodiment, a method includes administering to the subject an amount of a human monoclonal anti-M2e or anti-HA antibody effective to prevent an increase in influenza virus titer, virus replication or an amount of an influenza viral protein of one or more influenza strains or isolates in the subject.

Methods for protecting a subject from infection or decreasing susceptibility of a subject to infection by one or more influenza strains/isolates or subtypes, i.e., prophylactic methods, are additionally provided. In one embodiment, a method includes administering to the subject an amount of human monoclonal anti-M2e or anti-HA antibody that specifically binds influenza M2 or HA, respectively, effective to protect the subject from infection, or effective to decrease susceptibility of the subject to infection, by one or more influenza strains/isolates or subtypes.

Optionally, the subject is further administered with a second agent such as, but not limited to, an influenza virus antibody, an anti-viral drug such as a neuraminidase inhibitor, a HA inhibitor, a sialic acid inhibitor or an M2 ion channel inhibitor, a viral entry inhibitor or a viral attachment inhibitor. The M2 ion channel inhibitor is for example amantadine or rimantadine. The neuraminidase inhibitor for example zanamivir, or oseltamivir phosphate.

Symptoms or complications of influenza infection that can be reduced or decreased include, for example, chills, fever, cough, sore throat, nasal congestion, sinus congestion, nasal infection, sinus infection, body ache, head ache, fatigue, pneumonia, bronchitis, ear infection, ear ache or death.

For in vivo treatment of human and non-human patients, the patient is usually administered or provided a pharmaceutical formulation including a human monoclonal anti-M2e or anti-HA antibody of the invention. When used for in vivo therapy, the antibodies of the invention are administered to the patient in therapeutically effective amounts (i.e., amounts that eliminate or reduce the patient's viral burden). The antibodies are administered to a human patient, in accord with known methods, such as intravenous administration, e.g., as a bolus or by continuous infusion over a period of time, by intramuscular, intraperitoneal, intracerobrospinal, subcutaneous, intra-articular, intrasynovial, intrathecal, oral, topical, or inhalation routes. The antibodies may be administered parenterally, when possible, at the target cell site, or intravenously. Intravenous or subcutaneous administration of the antibody is preferred in certain embodiments. Therapeutic compositions of the invention are administered to a patient or subject systemically, parenterally, or locally.

For parenteral administration, the antibodies are formulated in a unit dosage injectable form (solution, suspension, emulsion) in association with a pharmaceutically acceptable, parenteral vehicle. Examples of such vehicles are water, saline, Ringer's solution, dextrose solution, and 5% human serum albumin. Nonaqueous vehicles such as fixed oils and ethyl oleate are also used. Liposomes are used as carriers. The vehicle contains minor amounts of additives such as substances that enhance isotonicity and chemical stability, e.g., buffers and preservatives. The antibodies are typically formulated in such vehicles at concentrations of about 1 mg/ml to 10 mg/ml.

The dose and dosage regimen depends upon a variety of factors readily determined by a physician, such as the nature of the infection and the characteristics of the particular cytotoxic agent or growth inhibitory agent conjugated to the antibody (when used), e.g., its therapeutic index, the patient, and the patient's history. Generally, a therapeutically effective amount of an antibody is administered to a patient. In particular embodiments, the amount of antibody administered is in the range of about 0.1 mg/kg to about 50 mg/kg of patient body weight. Depending on the type and severity of the infection, about 0.1 mg/kg to about 50 mg/kg body weight (e.g., about 0.1-15 mg/kg/dose) of antibody is an initial candidate dosage for administration to the patient, whether, for example, by one or more separate administrations, or by continuous infusion. The progress of this therapy is readily monitored by conventional methods and assays and based on criteria known to the physician or other persons of skill in the art.

In one particular embodiment, an immunoconjugate including the antibody conjugated with a cytotoxic agent is administered to the patient. Preferably, the immunoconjugate is internalized by the cell, resulting in increased therapeutic efficacy of the immunoconjugate in killing the cell to which it binds. In one embodiment, the cytotoxic agent targets or interferes with the nucleic acid in the infected cell. Examples of such cytotoxic agents are described above and include, but are not limited to, maytansinoids, calicheamicins, ribonucleases and DNA endonucleases.

Other therapeutic regimens are combined with the administration of the HuM2e antibody of the present invention. The combined administration includes co-administration, using separate formulations or a single pharmaceutical formulation, and consecutive administration in either order, wherein preferably there is a time period while both (or all) active agents simultaneously exert their biological activities. Preferably such combined therapy results in a synergistic therapeutic effect.

In certain embodiments, it is desirable to combine administration of an antibody of the invention with another antibody directed against another antigen associated with the infectious agent.

Aside from administration of the antibody protein to the patient, the invention provides methods of administration of the antibody by gene therapy. Such administration of nucleic acid encoding the antibody is encompassed by the expression "administering a therapeutically effective amount of an antibody". See, for example, PCT Patent Application Publication WO96/07321 concerning the use of gene therapy to generate intracellular antibodies.

In another embodiment, human monoclonal anti-M2e or anti-HA antibodies of the invention are used to determine the structure of bound antigen, e.g., conformational epitopes, the structure of which is then used to develop a vaccine having or mimicking this structure, e.g., through chemical modeling and SAR methods. Such a vaccine could then be used to prevent Influenza A infection.

All of the above U.S. patents, U.S. patent application publications, U.S. patent applications, foreign patents, foreign patent applications and non-patent publications referred to in this specification and/or listed in the Application Data Sheet are incorporated herein by reference, in their entirety.

EXAMPLES

Example 1

Screening and Characterization of M2e-specific Antibodies Present in Human Plasma Using Cells Expressing Recombinant M2e Protein Fully human monoclonal antibodies specific for M2 and capable of binding to influenza A infected cells and the influenza virus itself were identified in patient serum, as described below.

Expression of M2 in Cell Lines

An expression construct containing the M2 full length cDNA, corresponding to the derived M2 sequence found in Influenza subtype H3N2, was transfected into 293 cells.

The M2 cDNA is encoded by the following polynucleotide sequence and SEQ ID NO: 53:

```
ATGAGTCTTCTAACCGAGGTCGAAACGCCTATCAGAAACGAATGGGGG

TGCAGATGCAACGATTCAAGTGATCCTCTTGTTGTTGCCGCAAGTATC

ATTGGGATCCTGCACTTGATATTGTGGATTCTTGATCGTCTTTTTTC

AAATGCATTTATCGTCTCTTTAAACACGGTCTGAAAAGAGGGCCTTCT

ACGGAAGGAGTACCAGAGTCTATGAGGGAAGAATATCGAAAGGAACAG

CAGAGTGCTGTGGATGCTGACGATAGTCATTTTGTCAACATAGAGCTGG

AG
```

The cell surface expression of M2 was confirmed using the anti-M2e peptide specific MAb 14C2. Two other variants of M2, from A/Hong Kong/483/1997 (HK483) and A/Vietnam/1203/2004 (VN1203), were used for subsequent analyses, and their expression was determined using M2e-specific monoclonal antibodies of the present invention, since 14C2 binding may be abrogated by the various amino acid substitutions in M2e.

Screening of Antibodies in Peripheral Blood

Over 120 individual plasma samples were tested for antibodies that bound M2. None of them exhibited specific binding to the M2e peptide. However, 10% of the plasma samples contained antibodies that bound specifically to the 293-M2 H3N2 cell line. This indicates that the antibodies could be categorized as binding to conformational determinants of an M2 homotetramer, and binding to conformational determinants of multiple variants of the M2 homotetramer; they could not be specific for the linear M2e peptide.

Characterization of Anti-M2 MAbs

The human MAbs identified through this process proved to bind to conformational epitopes on the M2 homotetramer. They bound to the original 293-M2 transfectant, as well as to the two other cell-expressed M2 variants. The 14C2 MAb, in addition to binding the M2e peptide, proved to be more sensitive to the M2 variant sequences. Moreover, 14C2 does not readily bind influenza virions, while the conformation specific anti-M2 MAbs did.

These results demonstrate that the methods of the invention provide for the identification of M2 MAbs from normal human immune responses to influenza without a need for specific immunization of M2. If used for immunotherapy, these fully human MAbs have the potential to be better tolerated by patients that humanized mouse antibodies. Additionally, and in contrast to 14C2 and the Gemini Biosciences MAbs, which bind to linear M2e peptide, the MAbs of the invention bind to conformational epitopes of M2, and are specific not only for cells infected with A strain influenza, but also for the virus itself. Another advantage of the MAbs of the invention is that they each bind all of the M2 variants yet tested, indicating that they are not restricted to a specific linear amino acid sequence.

Example 2

Identification of M2-Specific Antibodies

Mononuclear or B cells expressing three of the MAbs identified in human serum as described in Example 1 were diluted into clonal populations and induced to produce antibodies. Antibody containing supernatants were screened for binding to 293 FT cells stably transfected with the full length M2E protein from influenza strain Influenza subtype H3N2. Supernatants which showed positive staining/binding were re-screened again on 293 FT cells stably transfected with the full length M2E protein from influenza strain Influenza subtype H3N2 and on vector alone transfected cells as a control.

The variable regions of the antibodies were then rescue cloned from the B cell wells whose supernatants showed positive binding. Transient transfections were performed in 293 FT cells to reconstitute and produce these antibodies. Reconstituted antibody supernatants were screened for binding to 293 FT cells stably transfected with the full length M2E protein as detailed above to identify the rescued anti-M2E antibodies. Three different antibodies were identified: 8i10, 21B15 and 23K12. A fourth additional antibody clone was isolated by the rescue screens, 4C2. However, it was not unique and had the exact same sequence as clone 8i10 even though it came from a different donor than clone 8i10.

The sequences of the kappa and gamma variable regions of these antibodies are provided below.

Clone 8i10 (Corresponds to TCN-032):

The Kappa LC variable region of the anti M2 clone 8i10 was cloned as Hind III to BsiW1 fragment (see below), and is encoded by the following polynucleotide sequences, and SEQ ID NO: 54 (top) and SEQ ID NO: 55 (bottom):

```
HindIII
AAGCTTCCACCATGGACATGAGGGTCCTCGCTCAGCTCCTGGGGCTCCTGCTACTCTGGCTCCGAGGTG
TTCGAAGGTGGTACCTGTACTCCCAGGAGCGAGTCGAGGACCCCGAGGACGATGAGACCGAGGCTCCAC
```

-continued

```
CCAGATGTGACATCCAGATGACCCAGTCTCCATCCTCCCTGTCTGCATCTGTAGGAGACAGAGTCACCA
GGTCTACACTGTAGGTCTACTGGGTCAGAGGTAGGAGGGACAGACGTAGACATCCTCTGTCTCAGTGGT

TCACTTGCCGGGCGAGTCAGAACATTTACAAGTATTTAAATTGGTATCAGCAGAGACCAGGGAAAGCCC
AGTGAACGGCCCGCTCAGTCTTGTAAATGTTCATAAATTTAACCATAGTCGTCTCTGGTCCCTTTCGGG

CTAAGGGCCTGATCTCTGCTGCATCCGGGTTGCAAAGTGGGGTCCCATCAAGGTTCAGTGGCAGTGGAT
GATTCCCGGACTAGAGACGACGTAGGCCCAACGTTTCACCCCAGGGTAGTTCCAAGTCACCGTCACCTA

CTGGGACAGATTTCACTCTCACCATCACCAGTCTGCAACCTGAAGATTTTGCAACTTACTACTGTCAAC
GACCCTGTCTAAAGTGAGAGTGGTAGTGGTCAGACGTTGGACTTCTAAAACGTTGAATGATGACAGTTG

BsiWI
AGAGTTACAGTCCCCCTCTCACTTTCGGCGGAGGGACCAGGGTGGAGATCAAACGTACG
TCTCAATGTCAGGGGAGAGTGAAAGCCGCCTCCCTGGTCCCACCTCTAGTTTGCATGC
                                                              15
```

The translation of the 8i10 Kappa LC variable region is as follows, polynucleotide sequence (above, SEQ ID NO: 54, top) and amino acid sequence (below, corresponding to residues 1-131 of SEQ ID NO: 56):

```
HindIII
AAGCTTCCACCATGGACATGAGGGTCCTCGCTCAGCTCCTGGGGCTCCTGCTACTCTGGCTCCGAGGTG
            M   D   M   R   V   L   A   Q   L   L   G   L   L   L   L   W   L   R   G CCAGATGTGACATCCAGATGACCCAGTCTCCATCCTCCCTGTCTGCATCTGTAGGAGACAGAGTCACCA
  A   R   C   D   I   Q   M   T   Q   S   P   S   S   L   S   A   S   V   G   D   R   V   T TCACTTGCCGGGCGAGTCAGAACATTTACAAGTATTTAAATTGGTATCAGCAGAGACCAGGGAAAGCCC
  I   T   C   R   A   S   Q   N   I   Y   K   Y   L   N   W   Y   Q   Q   R   P   G   K   A CTAAGGGCCTGATCTCTGCTGCATCCGGGTTGCAAAGTGGGGTCCCATCAAGGTTCAGTGGCAGTGGAT
  P   K   G   L   I   S   A   A   S   G   L   Q   S   G   V   P   S   R   F   S   G   S   G CTGGGACAGATTTCACTCTCACCATCACCAGTCTGCAACCTGAAGATTTTGCAACTTACTACTGTCAAC
  S   G   T   D   F   T   L   T   I   T   S   L   Q   P   E   D   F   A   T   Y   Y   C   Q BsiWI
AGAGTTACAGTCCCCCTCTCACTTTCGGCGGAGGGACCAGGGTGGAGATCAAACGTACG
  Q   S   Y   S   P   P   L   T   F   G   G   G   T   R   V   E   I   K   R   T
```

The amino acid sequence of the 8i10 Kappa LC variable region is as follows, with specific domains identified below (CDR sequences defined according to Kabat methods):

| | |
|---|---|
| M D M R V L A Q L L G L L L L W L R G A R C | VK leader (SEQ ID NO: 57) |
| D I Q M T Q S P S S L S A S V G D R V T I T C | FR1 (SEQ ID NO: 58) |
| R A S Q N I Y K Y L N | CDR1 (SEQ ID NO: 59) |
| W Y Q Q R P G K A P K G L I S | FR2 (SEQ ID NO: 60) |
| A A S G L Q S | CDR2 (SEQ ID NO: 61) |
| G V P S R F S G S G S G T D F T L T I T S L Q P E D F A T Y Y C | FR3 (SEQ ID NO: 62) |
| Q Q S Y S P P L T | CDR3 (SEQ ID NO: 63) |
| F G G G T R V E I K | FR4 (SEQ ID NO: 64) |
| R T | Start of Kappa constant region |

The following is an example of the Kappa LC variable region of 8i10 cloned into the expression vector pcDNA3.1 which already contained the Kappa LC constant region (upper polynucleotide sequence corresponds to SEQ ID NO: 65, lower polynucleotide sequence corresponds to SEQ ID NO: 66, amino acid sequence corresponds to SEQ ID NO: 56). Bases in black represents pcDNA3.1 vector sequences, underlined bases represent the cloned antibody sequences. The antibodies described herein have also been cloned into the expression vector pCEP4.

```
                                    NheI(894) PmeI (909) HindIII(910)
TCGAAATTAATACGACTCACTATAGGGAGACCCAAGCTGGCTAGCGTTTAAACTTAAGCTTCCACCATG
AGCTTTAATTATGCTGAGTGATATCCCTCTGGGTTCGACCGATCGCAAATTTGAATTCGAAGGTGGTAC
                                                                 M GACATGAGGGTCCTCGCTCAGCTCCTGGGGCTCCTGCTACTCTGGCTCCGAGGTGCCAGATGTG
CTGTACTCCCAGGAGCGAGTCGAGGACCCCGAGGACGATGAGACCGAGGCTCCACGGTCTACAC
 D   M   R   V   L   A   Q   L   L   G   L   L   L   W   L   R   G   A   R   C ACATCCAGATGACCCAGTCTCCATCCTCCCTGTCTGCATCTGTAGGAGACAGAGTCACCATCAC
TGTAGGTCTACTGGGTCAGAGGTAGGAGGGACAGACGTAGACATCCTCTGTCTCAGTGGTAGTG
 D   I   Q   M   T   Q   S   P   S   S   L   S   A   S   V   G   D   R   V   T   I   T TTGCCGGGCGAGTCAGAACATTTACAAGTATTTAAATTGGTATCAGCAGAGACCAGGGAAAGCC
AACGGCCCGCTCAGTCTTGTAAATGTTCATAAATTTAACCATAGTCGTCTCTGGTCCCTTTCGG
 C   R   A   S   Q   N   I   Y   K   Y   L   N   W   Y   Q   Q   R   P   G   K   A CCTAAGGGCCTGATCTCTGCTGCATCCGGGTTGCAAAGTGGGGTCCCATCAAGGTTCAGTGGCA
GGATTCCCGGACTAGAGACGACGTAGGCCCAACGTTTCACCCCAGGGTAGTTCCAAGTCACCGT
 P   K   G   L   I   S   A   A   S   G   L   Q   S   G   V   P   S   R   F   S   G GTGGATCTGGGACAGATTTCACTCTCACCATCACCAGTCTGCAACCTGAAGATTTTGCAACTTA
CACCTAGACCCTGTCTAAAGTGAGAGTGGTAGTGGTCAGACGTTGGACTTCTAAAACGTTGAAT
 S   G   S   G   T   D   F   T   L   T   I   T   S   L   Q   P   E   D   F   A   T   Y CTACTGTCAACAGAGTTACAGTCCCCCTCTCACTTTCGGCGGAGGGACCAGGGTGGAGATCAAA
GATGACAGTTGTCTCAATGTCAGGGGGAGAGTGAAAGCCGCCTCCCTGGTCCCACCTCTAGTTT
  Y   C   Q   Q   S   Y   S   P   P   L   T   F   G   G   G   T   R   V   E   I   K BsiWI
CGTACGGTGGCTGCACCATCTGTCTTCATCTTCCCGCCATCTGATGAGCAGTTGAAATCTGGAACTGCCT
GCATGCCACCGACGTGGTAGACAGAAGTAGAAGGGCGGTAGACTACTCGTCAACTTTAGACCTTGACGGA
  R   T   V   A   A   P   S   V   F   I   F   P   P   S   D   E   Q   L   K   S   G   T   A CTGTTGTGTGCCTGCTGAATAACTTCTATCCCAGAGAGGCCAAAGTACAGTGGAAGGTGGATAACGCCCT
GACAACACACGGACGACTTATTGAAGATAGGGTCTCTCCGGTTTCATGTCACCTTCCACCTATTGCGGGA
  S   V   V   C   L   L   N   N   F   Y   P   R   E   A   K   V   Q   W   K   V   D   N   A   L hu Kappa constant
CCAATCGGGTAACTCCCAGGAGAGTGTCACAGAGCAGGACAGCAAGGACAGCACCTACAGCCTCAGCAGC
GGTTAGCCCATTGAGGGTCCTCTCACAGTGTCTCGTCCTGTCGTTCCTGTCGTGGATGTCGGAGTCGTCG
  Q   S   G   N   S   Q   E   S   V   T   E   Q   D   S   K   D   S   T   Y   S   L   S   S ACCCTGACGCTGAGCAAAGCAGACTACGAGAAACACAAAGTCTACGCCTGCGAAGTCACCCATCAGGGCC
TGGGACTGCGACTCGTTTCGTCTGATGCTCTTTGTGTTTCAGATGCGGACGCTTCAGTGGGTAGTCCCGG
  T   L   T   L   S   K   A   D   Y   E   K   H   K   V   Y   A   C   E   V   T   H   Q   G DraI(1641)
                                                     XbaI(1636) ApaI(1642)
TGAGCTCGCCCGTCACAAAGAGCTTCAACAGGGGAGAGTGTTAGAGGGTCTAGAGGGCCCGTTTAAA
ACTCGAGCGGGCAGTGTTTCTCGAAGTTGTCCCCTCTCACAATCTCCCAGATCTCCCGGGCAAATTT
  L   S   S   P   V   T   K   S   F   N   R   G   E   C
```

The 8i10 Gamma HC variable region was cloned as a Hind III to Xho 1 fragment, and is encoded the following polynucleotide sequences, and SEQ ID NO: 67 (top) and SEQ ID NO: 68 (bottom).

```
HindIII
AAGCTTCCACCATGAAACACCTGTGGTTCTTCCTTCTCCTGGTGGCAGCTCCCAGCTGGGT
TTCGAAGGTGGTACTTTGTGGACACCAAGAAGGAAGAGGACCACCGTCGAGGGTCGACCCA CCTGTCCCAGGTGCAATTGCAGGAGTCGGGCCCAGGACTGGTGAAGCCTTCGGAGACCCTG
GGACAGGGTCCACGTTAACGTCCTCAGCCCGGGTCCTGACCACTTCGGAAGCCTCTGGGAC TCCCTCACCTGCACTGTCTCTGGTTCGTCCATCAGTAATTACTACTGGAGCTGGATCCGGC
AGGGAGTGGACGTGACAGAGACCAAGCAGGTAGTCATTAATGATGACCTCGACCTAGGCCG AGTCCCCAGGGAAGGGACTGGAGTGGATTGGGTTTATCTATTACGGTGGAAACACCAAGTA
TCAGGGGTCCCTTCCCTGACCTCACCTAACCCAAATAGATAATGCCACCTTTGTGGTTCAT CAATCCCTCCCTCAAGAGCCGCGTCACCATATCACAAGACACTTCCAAGAGTCAGGTCTCC
GTTAGGGAGGGAGTTCTCGGCGCAGTGGTATAGTGTTCTGTGAAGGTTCTCAGTCCAGAGG CTGACGATGAGCTCTGTGACCGCTGCGGAATCGGCCGTCTATTTCTGTGCGAGAGCGTCTT
GACTGCTACTCGAGACACTGGCGACGCCTTAGCCGGCAGATAAAGACACGCTCTCGCAGAA XhoI
GTAGTGGTGGTTACTGTATCCTTGACTACTGGGGCCAGGGAACCCTGGTCACCGTCTCGAG
CATCACCACCAATGACATAGGAACTGATGACCCCGGTCCCTTGGGACCAGTGGCAGAGCTC
```

The translation of the 8i10 Gamma HC is as follows, polynucleotide sequence (above, SEQ ID NO: 67, top) and amino acid sequence (below, corresponding to residues 1-138 of SEQ ID NO: 69):

```
HindIII
AAGCTTCCACCATGAAACACCTGTGGTTCTTCCTTCTCCTGGTGGCAGCTCCCAGCTGGGTC
            M   K   H   L   W   F   F   L   L   L   V   A   A   P   S   W   V CTGTCCCAGGTGCAATTGCAGGAGTCGGGCCCAGGACTGGTGAAGCCTTCGGAGACCCTG
 L   S   Q   V   Q   L   Q   E   S   G   P   G   L   V   K   P   S   E   T   L TCCCTCACCTGCACTGTCTCTGGTTCGTCCATCAGTAATTACTACTGGAGCTGGATCCGG
 S   L   T   C   T   V   S   G   S   S   I   S   N   Y   Y   W   S   W   I   R CAGTCCCCAGGGAAGGGACTGGAGTGGATTGGGTTTATCTATTACGGTGGAAACACCAAG
 Q   S   P   G   K   G   L   E   W   I   G   F   I   Y   Y   G   G   N   T   K TACAATCCCTCCCTCAAGAGCCGCGTCACCATATCACAAGACACTTCCAAGAGTCAGGTC
 Y   N   P   S   L   K   S   R   V   T   I   S   Q   D   T   S   K   S   Q   V TCCCTGACGATGAGCTCTGTGACCGCTGCGGAATCGGCCGTCTATTTCTGTGCGAGAGCG
 S   L   T   M   S   S   V   T   A   A   E   S   A   V   Y   F   C   A   R   A XhoI
TCTTGTAGTGGTGGTTACTGTATCCTTGACTACTGGGGCCAGGGAACCCTGGTCACCGTC
 S   C   S   G   G   Y   C   I   L   D   Y   W   G   Q   G   T   L   V   T   V

TCGAG
 S
```

The amino acid sequence of the 8i10 Gamma HC is as follows with specific domains identified below (CDR sequences defined according to Kabat methods):

M K H L W F F L L L V A A P S W V L S    VH leader (SEQ ID NO: 70)

Q V Q L Q E S G P G L V K P S E T L S L T C T V S G S S I S    FR1 (SEQ ID NO: 71)

N Y Y W S    CDR1 (SEQ ID NO: 72)

W I R Q S P G K G L E W I G    FR2 (SEQ ID NO: 73)

F I Y Y G G N T K Y N P S L K S    CDR2 (SEQ ID NO: 74)

R V T I S Q D T S K S Q V S L T M S S V T A A E S A V Y F C A R    FR3 (SEQ ID NO: 75)

A S C S G G Y C I L D

Y W G Q G T L V T V S

YWGQGTLVTVSS

CDR3 (SEQ ID NO: 76)

FR4 (SEQ ID NO: 77)

Long FR4 (SEQ ID NO: 266)

The following is an example of the Gamma HC variable region of 8i10 cloned into the expression vector pcDNA3.1 which already contained the Gamma HC constant region (upper polynucleotide sequence corresponds to SEQ ID NO: 78, lower polynucleotide sequence corresponds to SEQ ID NO: 79, amino acid sequence corresponds to SEQ ID NO: 69). Bases in black represents pcDNA3.1 vector sequences, underlined bases represent the cloned antibody sequences.

```
                                                       PmeI (900)
                                              NheI (894)   Hind(910)
TGGCTTATCGAAATTAATACGACTCACTATAGGGAGACCCAAGCTGGCTAGCGTTTAAACTTAAGCT
ACCGAATAGCTTTAATTATGCTGAGTGATATCCCTCTGGGTTCGACCGATCGCAAATTTGAATTCGA TCCACCATGAAACACCTGTGGTTCTTCCTTCTCCTGGTGGCAGCTCCCAGCTGGGTCCTGTCCC
AGGTGGTACTTTGTGGACACCAAGAAGGAAGAGGACCACCGTCGAGGGTCGACCCAGGACAGGG
        M   K   H   L   W   F   F   L   L   L   V   A   A   P   S   W   V   L   S AGGTGCAATTGCAGGAGTCGGGCCCAGGACTGGTGAAGCCTTCGGAGACCCTGTCCCTCACCTG
TCCACGTTAACGTCCTCAGCCCGGGTCCTGACCACTTCGGAAGCCTCTGGGACAGGGAGTGGAC
  Q   V   Q   L   Q   E   S   G   P   G   L   V   K   P   S   E   T   L   S   L   T   C CACTGTCTCTGGTTCGTCCATCAGTAATTACTACTGGAGCTGGATCCGGCAGTCCCCAGGGAAG
GTGACAGAGACCAAGCAGGTAGTCATTAATGATGACCTCGACCTAGGCCGTCAGGGGTCCCTTC
  T   V   S   G   S   S   I   S   N   Y   Y   W   S   W   I   R   Q   S   P   G   K GGACTGGAGTGGATTGGGTTTATCTATTACGGTGGAAACACCAAGTACAATCCCTCCCTCAAGA
CCTGACCTCACCTAACCCAAATAGATAATGCCACCTTTGTGGTTCATGTTAGGGAGGGAGTTCT
  G   L   E   W   I   G   F   I   Y   Y   G   G   N   T   K   Y   N   P   S   L   K GCCGCGTCACCATATCACAAGACACTTCCAAGAGTCAGGTCTCCCTGACGATGAGCTCTGTGAC
CGGCGCAGTGGTATAGTGTTCTGTGAAGGTTCTCAGTCCAGAGGGACTGCTACTCGAGACACTG
  S   R   V   T   I   S   Q   D   T   S   K   S   Q   V   S   S   L   M   S   S   V   T CGCTGCGGAATCGGCCGTCTATTTCTGTGCGAGAGCGTCTTGTAGTGGTGGTTACTGTATCCTT
GCGACGCCTTAGCCGGCAGATAAAGACACGCTCTCGCAGAACATCACCACCAATGACATAGGAA
    A   A   E   S   A   V   Y   F   C   A   R   A   S   C   S   G   G   Y   C   I   L XhoI (1331)
GACTACTGGGGCCAGGGAACCCTGGTCACCGTCTCGAGAGCCTCCACCAAGGGCCCATCGGTCTTC
CTGATGACCCCGGTCCCTTGGGACCAGTGGCAGAGCTCTCGGAGGTGGTTCCCGGGTAGCCAGAAG
    D   Y   W   G   Q   G   T   L   V   T   V   S   R   A   S   T   K   G   P   S   V   F CCCCTGGCACCCTCCTCCAAGAGCACCTCTGGGGGCACAGCGGCCCTGGGCTGCCTGGTCAAGGACT
GGGGACCGTGGGAGGAGGTTCTCGTGGAGACCCCCGTGTCGCCGGGACCCGACGGACCAGTTCCTGA
    P   L   A   P   S   S   K   S   T   S   G   G   T   A   A   L   G   C   L   V   K   D ACTTCCCCGAACCGGTGACGGTGTCGTGGAACTCAGGCGCCCTGACCAGCGGCGTGCACACCTTCCC
TGAAGGGGCTTGGCCACTGCCACAGCACCTTGAGTCCGCGGGACTGGTCGCCGCACGTGTGGAAGGG
  Y   F   P   E   P   V   T   V   S   W   N   S   G   A   L   T   S   G   V   H   T   F   P GGCTGTCCTACAGTCCTCAGGACTCTACTCCCTCAGCAGCGTGGTGACCGTGCCCTCCAGCAGCTTG
CCGACAGGATGTCAGGAGTCCTGAGATGAGGGAGTCGTCGCACCACTGGCACGGGAGGTCGTCGAAC
    A   V   L   Q   S   S   G   L   Y   S   L   S   S   V   V   T   V   P   S   S   S   L GGCACCCAGACCTACATCTGCAACGTGAATCACAAGCCCAGCAACACCAAGGTGGACAAGAGAGTTG
CCGTGGGTCTGGATGTAGACGTTGCACTTAGTGTTCGGGTCGTTGTGGTTCCACCTGTTCTCTCAAC
  G   T   Q   T   Y   I   C   N   V   N   H   K   P   S   N   T   K   V   D   K   R   V AGCCCAAATCTTGTGACAAAACTCACACATGCCCACCGTGCCCAGCACCTGAACTCCTGGGGGGACC
TCGGGTTTAGAACACTGTTTTGAGTGTGTACGGGTGGCACGGGTCGTGGACTTGAGGACCCCCCTGG
  E   P   K   S   C   D   K   T   H   T   C   P   P   C   P   A   P   E   L   L   G   P GTCAGTCTTCCTCTTCCCCCCAAAACCCAAGGACACCCTCATGATCTCCCGGACCCCTGAGGTCACA
CAGTCAGAAGGAGAAGGGGGGTTTTGGGTTCCTGTGGGAGTACTAGAGGGCCTGGGGACTCCAGTGT
    S   V   F   L   F   P   P   K   P   K   D   T   L   M   I   S   R   T   P   E   V   T TGCGTGGTGGTGGACGTGAGCCACGAAGACCCTGAGGTCAAGTTCAACTGGTACGTGGACGGCGTGG
ACGCACCACCACCTGCACTCGGTGCTTCTGGGACTCCAGTTCAAGTTGACCATGCACCTGCCGCACC
  C   V   V   V   D   V   S   H   E   D   P   E   V   K   F   N   W   Y   V   D   G   V AGGTGCATAATGCCAAGACAAAGCCGCGGGAGGAGCAGTACAACAGCACGTACCGTGTGGTCAGCGT
TCCACGTATTACGGTTCTGTTTCGGCGCCCTCCTCGTCATGTTGTCGTGCATGGCACACCAGTCGCA
  E   V   H   N   A   K   T   K   P   R   E   E   Q   Y   N   S   T   Y   R   V   V   S   V

CCTCACCGTCCTGCACCAGGACTGGCTGAATGGCAAGGAGTACAAGTGCAAGGTCTCCAACAAAGCC
```

```
                                       -continued
GGAGTGGCAGGACGTGGTCCTGACCGACTTACCGTTCCTCATGTTCACGTTCCAGAGGTTGTTTCGG
  L   T   V   L   H   Q   D   W   L   N   G   K   E   Y   K   C   K   V   S   N   K   A CTCCCAGCCCCCATCGAGAAAACCATCTCCAAAGCCAAAGGGCAGCCCCGAGAACCACAGGTGTACA
GAGGGTCGGGGGTAGCTCTTTTGGTAGAGGTTTCGGTTTCCCGTCGGGGCTCTTGGTGTCCACATGT
  L   P   A   P   I   E   K   T   I   S   K   A   K   G   Q   P   R   E   P   Q   V   Y CCCTGCCCCCATCCCGGGAGGAGATGACCAAGAACCAGGTCAGCCTGACCTGCCTGGTCAAAGGCTT
GGGACGGGGGTAGGGCCCTCCTCTACTGGTTCTTGGTCCAGTCGGACTGGACGGACCAGTTTCCGAA
  T   L   P   P   S   R   E   E   M   T   K   N   Q   V   S   L   T   C   L   V   K   G   F CTATCCCAGCGACATCGCCGTGGAGTGGGAGAGCAATGGGCAGCCGGAGAACAACTACAAGACCACG
GATAGGGTCGCTGTAGCGGCACCTCACCCTCTCGTTACCCGTCGGCCTCTTGTTGATGTTCTGGTGC
  Y   P   S   D   I   A   V   E   W   E   S   N   G   Q   P   E   N   N   Y   K   T   T CCTCCCGTGCTGGACTCCGACGGCTCCTTCTTCCTCTATAGCAAGCTCACCGTGGACAAGAGCAGGT
GGAGGGCACGACCTGAGGCTGCCGAGGAAGAAGGAGATATCGTTCGAGTGGCACCTGTTCTCGTCCA
  P   P   V   L   D   S   D   G   S   F   F   L   Y   S   K   L   T   V   D   K   S   R GGCAGCAGGGGAACGTCTTCTCATGCTCCGTGATGCATGAGGCTCTGCACAACCACTACACGCAGAA
CCGTCGTCCCCTTGCAGAAGAGTACGAGGCACTACGTACTCCGAGACGTGTTGGTGATGTGCGTCTT
  W   Q   Q   G   N   V   F   S   C   S   V   M   H   E   A   L   H   N   H   Y   T   Q   K ApaI (2339)
                                    DraII(2338)
                       XhoI (2333)     PmeI (2345)
GAGCCTCTCCCTGTCTCCGGGTAAATGAGTTCTAGAGGGCCCGTTTAAACCCGCTGATCAGCCTCGA
CTCGGAGAGGGACAGAGGCCCATTTACTCAAGATCTCCCGGGCAAATTTGGGCGACTAGTCGGAGCT
  S   L   S   L   S   P   G   K
```

The framework 4 (FR4) region of the Gamma HC normally ends with two serines (SS), so that the full framework 4 region should be WGQGTLVTVSS (SEQ ID NO: 80). The accepting Xho 1 site and one additional base downstream of the Xho1 site in the vector; in which the Gamma HC constant region that the Gamma HC variable regions are cloned, supplies the last bases, which encode this final amino acid of framework 4. However, the original vector did not adjust for the silent mutation made when the Xho1 site (CTCGAG, SEQ ID NO: 81) was created and contained an "A" nucleotide downstream of the Xho1 site, which caused an amino acid change at the end of framework 4: a serine to arginine (S to R) substitution present in all the working Gamma HC clones.

Thus, the full framework 4 region reads WGQGTLVTVSR (SEQ ID NO: 82). Future constructs are being created wherein the base downstream of the Xho 1 site is a "C" nucleotide. Thus, the creation of the Xho 1 site used for cloning of the Gamma HC variable region sequences in alternative embodiments is a silent mutation and restores the framework 4 amino acid sequence to its proper WGQGTLV TVSS (SEQ ID NO: 80). This is true for all M2 Gamma HC clones described herein.

Clone 21B15:

The Kappa LC variable region of the anti M2 clone 21B15 was cloned as Hind III to BsiW1 fragment, and is encoded by the following polynucleotide sequences and SEQ ID NO: 83 and SEQ ID NO: 84:

```
HindIII
AAGCTTCCACCATGGACATGAGGGTCCTCGCTCAGCTCCTGGGGCTCCTGCTACTCTGGCTCCGAGGTGC
TTCGAAGGTGGTACCTGTACTCCCAGGAGCGAGTCGAGGACCCCGAGGACGATGAGACCGAGGCTCCACG CAGATGTGACATCCAGGTGACCCAGTCTCCATCCTCCCTGTCTGCATCTGTAGGAGACAGAGTCACCATC
GTCTACACTGTAGGTCCACTGGGTCAGAGGTAGGAGGGACAGACGTAGACATCCTCTGTCTCAGTGGTAG ACTTGCCGCGCGAGTCAGAACATTTACAAGTATTTAAATTGGTATCAGCAGAGACCAGGGAAAGCCCCTA
TGAACGGCGCGCTCAGTCTTGTAAATGTTCATAAATTTAACCATAGTCGTCTCTGGTCCCTTTCGGGGAT AGGGCCTGATCTCTGCTGCATCCGGGTTGCAAAGTGGGGTCCCATCAAGGTTCAGTGGCAGTGGATCTGG
TCCCGGACTAGAGACGACGTAGGCCCAACGTTTCACCCCAGGGTAGTTCCAAGTCACCGTCACCTAGACC GACAGATTTCACTCTCACCATCACCAGTCTGCAACCTGAAGATTTTGCAACTTACTACTGTCAACAGAGT
CTGTCTAAAGTGAGAGTGGTAGTGGTCAGACGTTGGACTTCTAAAACGTTGAATGATGACAGTTGTCTCA BsiWI
TACAGTCCCCCTCTCACTTTCGGCGGAGGGACCAGGGTGGATATCAAACGTACG
ATGTCAGGGGGAGAGTGAAAGCCGCCTCCCTGGTCCCACCTATAGTTTGCATGC
```

The translation of the 21B15 Kappa LC variable region is as follows, polynucleotide sequence (above, SEQ ID NO: 83, top) and amino acid sequence (below, corresponding to SEQ ID NO: 298):

```
HindIII
AAGCTTCCACCATGGACATGAGGGTCCTCGCTCAGCTCCTGGGGCTCCTGCTACTCTGGCTCCGAGGT
            M  D  M  R  V  L  A  Q  L  L  G  L  L  L  L  W  L  R  G GCCAGATGTGACATCCAGGTGACCCAGTCTCCATCCTCCCTGTCTGCATCTGTAGGAGACAGAGTCACC
 A  R  C  D  I  Q  V  T  Q  S  P  S  S  L  S  A  S  V  G  D  R  V  T ATCACTTGCCGCGCGAGTCAGAACATTTACAAGTATTTAAATTGGTATCAGCAGAGACCAGGGAAAGCC
 I  T  C  R  A  S  Q  N  I  Y  K  Y  L  N  W  Y  Q  Q  R  P  G  K  A CCTAAGGGCCTGATCTCTGCTGCATCCGGGTTGCAAAGTGGGGTCCCATCAAGGTTCAGTGGCAGTGGA
 P  K  G  L  I  S  A  A  S  G  L  Q  S  G  V  P  S  R  F  S  G  S  G TCTGGGACAGATTTCACTCTCACCATCACCAGTCTGCAACCTGAAGATTTTGCAACTTACTACTGTCAA
 S  G  T  D  F  T  L  T  I  T  S  L  Q  P  E  D  F  A  T  Y  Y  C  Q BsiWI
CAGAGTTACAGTCCCCCTCTCACTTTCGGCGGAGGGACCAGGGTGGATATCAAACGTACG
 Q  S  Y  S  P  P  L  T  F  G  G  G  T  R  V  D  I  K  R  T
```

The amino acid sequence of the 21B15 Kappa LC variable region is as follows, with specific domains identified below (CDR sequences defined according to Kabat methods):

| | |
|---|---|
| M D M R V L A Q L L G L L L L W L R G A R C | VK leader (SEQ ID NO: 57) |
| D I Q V T Q S P S S L S A S V G D R V T I T C | FR1 (SEQ ID NO: 58) |
| R A S Q N I Y K Y L N | CDR1 (SEQ ID NO: 59) |
| W Y Q Q R P G K A P K G L I S | FR2 (SEQ ID NO: 60) |
| A A S G L Q S | CDR2 (SEQ ID NO: 61) |
| G V P S R F S G S G S G T D F T L T I T S L Q P E D F A T Y Y C | FR3 (SEQ ID NO: 62) |
| Q Q S Y S P P L T | CDR3 (SEQ ID NO: 63) |
| F G G G T R V D I K | FR4 (SEQ ID NO: 64) |
| R T | Start of Kappa constant region |

The primer used to clone the Kappa LC variable region extended across a region of diversity and had wobble base position in its design. Thus, in the framework 4 region a D or E amino acid could occur. In some cases, the amino acid in this position in the rescued antibody may not be the original parental amino acid that was produced in the B cell. In most kappa LCs the position is an E. Looking at the clone above (21B15) a D in framework 4 (DIKRT) (SEQ ID NO: 544) was observed. However, looking at the surrounding amino acids, this may have occurred as the result of the primer and may be an artifact. The native antibody from the B cell may have had an E in this position.

The 21B15 Gamma HC variable region was cloned as a Hind III to Xho 1 fragment, and is encoded by the following polynucleotide sequences and SEQ ID NO: 85 (top), and SEQ ID NO: 86 (bottom):

```
HindIII
AAGCTTCCACCATGAAACACCTGTGGTTCTTCCTTCTCCTGGTGGCAGCTCCCAGCTGGGTCC
TTCGAAGGTGGTACTTTGTGGACACCAAGAAGGAAGAGGACCACCGTCGAGGGTCGACCCAGG TGTCCCAGGTGCAATTGCAGGAGTCGGGCCCAGGACTGGTGAAGCCTTCGGAGACCCTGTCCC
ACAGGGTCCACGTTAACGTCCTCAGCCCGGGTCCTGACCACTTCGGAAGCCTCTGGGACAGGG TCACCTGCACTGTCTCTGGTTCGTCCATCAGTAATTACTACTGGAGCTGGATCCGGCAGTCCC
AGTGGACGTGACAGAGACCAAGCAGGTAGTCATTAATGATGACCTCGACCTAGGCCGTCAGGG CAGGGAAGGGACTGGAGTGGATTGGGTTTATCTATTACGGTGGAAACACCAAGTACAATCCCT
GTCCCTTCCCTGACCTCACCTAACCCAAATAGATAATGCCACCTTTGTGGTTCATGTTAGGGA CCCTCAAGAGCCGCGTCACCATATCACAAGACACTTCCAAGAGTCAGGTCTCCCTGACGATGA
GGGAGTTCTCGGCGCAGTGGTATAGTGTTCTGTGAAGGTTCTCAGTCCAGAGGGACTGCTACT GCTCTGTGACCGCTGCGGAATCGGCCGTCTATTTCTGTGCGAGAGCGTCTTGTAGTGGTGGTT
CGAGACACTGGCGACGCCTTAGCCGGCAGATAAAGACACGCTCTCGCAGAACATCACCACCAA
```

```
                                            XhoI
ACTGTATCCTTGACTACTGGGGCCAGGGAACCCTGGTCACCGTCTCGAG
TGACATAGGAACTGATGACCCCGGTCCCTTGGGACCAGTGGCAGAGCTC
```

The translation of the 21B15 Gamma HC is as follows, polynucleotide sequence (above, SEQ ID NO: 87, top) and amino acid sequence (below, corresponding to residues 1-138 of SEQ ID NO: 69):

```
HindIII
AAGCTTCCACCATGAAACACCTGTGGTTCTTCCTTCTCCTGGTGGCAGCTCCCAGCTGGGTC
              M   K   H   L   W   F   F   L   L   L   V   A   A   P   S   W   V CTGTCCCAGGTGCAATTGCAGGAGTCGGGCCCAGGACTGGTGAAGCCTTCGGAGACCCTGTCC
 L   S   Q   V   Q   L   Q   E   S   G   P   G   L   V   K   P   S   E   T   L   S CTCACCTGCACTGTCTCTGGTTCGTCCATCAGTAATTACTACTGGAGCTGGATCCGGCAGTCC
 L   T   C   T   V   S   G   S   S   I   S   N   Y   Y   W   S   W   I   R   Q   S CCAGGGAAGGGACTGGAGTGGATTGGGTTTATCTATTACGGTGGAAACACCAAGTACAATCCC
 P   G   K   G   L   E   W   I   G   F   I   Y   Y   G   G   N   T   K   Y   N   P TCCCTCAAGAGCCGCGTCACCATATCACAAGACACTTCCAAGAGTCAGGTCTCCCTGACGATG
 S   L   K   S   R   V   T   I   S   Q   D   T   S   K   S   Q   V   S   L   T   M AGCTCTGTGACCGCTGCGGAATCGGCCGTCTATTTCTGTGCGAGAGCGTCTTGTAGTGGTGGT
 S   S   V   T   A   A   E   S   A   V   Y   F   C   A   R   A   S   C   S   G   G XhoI
TACTGTATCCTTGACTACTGGGGCCAGGGAACCCTGGTCACCGTCTCGAG
 Y   C   I   L   D   Y   W   G   Q   G   T   L   V   T   V   S
```

The amino acid sequence of the 21B15 Gamma HC is as follows, with specific domains identified below (CDR sequences defined according to Kabat methods):

| | |
|---|---|
| M K H L W F F L L L V A A P S W V L S | VH leader (SEQ ID NO: 70) |
| Q V Q L Q E S G P G L V K P S E T L S L T C T V S G S S I S | FR1 (SEQ ID NO: 71) |
| N Y Y W S | CDR1 (SEQ ID NO: 72) |
| W I R Q S P G K G L E W I G | FR2 (SEQ ID NO: 73) |
| F I Y Y G G N T K Y N P S L K S | CDR2 (SEQ ID NO: 74) |
| R V T I S Q D T S K S Q V S L T M S S V T A A E S A V Y F C A R | FR3 (SEQ ID NO: 75) |
| A S C S G G Y C I L D | CDR3 (SEQ ID NO: 76) |
| Y W G Q G T L V T V S | FR4 (SEQ ID NO: 77) |
| YWGQGTLVTVSS | Long FR4 (SEQ ID NO: 266) |

Clone 23K12 (Corresponds to TCN-031):

The Kappa LC variable region of the anti M2 clone 23K12 was cloned as Hind III to BsiW1 fragment (see below), and is encoded by the following polynucleotide sequences SEQ ID NO: 88 (top) and SEQ ID NO: 89 (below).

```
HindIII
AAGCTTCCACCATGGACATGAGGGTCCTCGCTCAGCTCCTGGGGCTCCTGCTACTCTGGCTCCGAGG
TTCGAAGGTGGTACCTGTACTCCCAGGAGCGAGTCGAGGACCCCGAGGACGATGAGACCGAGGCTCC TGCCAGATGTGACATCCAGATGACCCAGTCTCCATCCTCCCTGTCTGCATCTGTAGGAGACAGAGTC
ACGGTCTACACTGTAGGTCTACTGGGTCAGAGGTAGGAGGGACAGACGTAGACATCCTCTGTCTCAG ACCATCACTTGCCGGACAAGTCAGAGCATTAGCAGCTATTTAAATTGGTATCAGCAGAAACCAGGGA
TGGTAGTGAACGGCCTGTTCAGTCTCGTAATCGTCGATAAATTTAACCATAGTCGTCTTTGGTCCCT AAGCCCCTAAACTCCTGATCTATGCTGCATCCAGTTTGCAAAGTGGGGTCCCATCAAGGTTCAGTGG
TTCGGGGATTTGAGGACTAGATACGACGTAGGTCAAACGTTTCACCCCAGGGTAGTTCCAAGTCACC
```

```
                              -continued
CAGTGGATCTGGGACAGATTTCACTCTCACCATCAGCGGTCTGCAACCTGAAGATTTTGCAACCTAC
GTCACCTAGACCCTGTCTAAAGTGAGAGTGGTAGTCGCCAGACGTTGGACTTCTAAAACGTTGGATG BslWI
TACTGTCAACAGAGTTACAGTATGCCTGCCTTTGGCCAGGGGACCAAGCTGGAGATCAAACGTACG
ATGACAGTTGTCTCAATGTCATACGGACGGAAACCGGTCCCCTGGTTCGACCTCTAGTTTGCATGC
```

The translation of the 23K12 Kappa LC variable region is as follows, polynucleotide sequence (above, SEQ ID NO: 90, top) and amino acid sequence (below, corresponding to SEQ ID NO: 91).

```
HindIII
  AAGCTTCCACCATGGACATGAGGGTCCTCGCTCAGCTCCTGGGGCTCCTGCTACTCTGGCTCCGAGG
              M  D  M  R  V  L  A  Q  L  L  G  L  L  L  L  W  L  R  G TGCCAGATGTGACATCCAGATGACCCAGTCTCCATCCTCCCTGTCTGCATCTGTAGGAGACAGAGTC
   A  R  C  D  I  Q  M  T  Q  S  P  S  S  L  S  A  S  V  G  D  R  V ACCATCACTTGCCGGACAAGTCAGAGCATTAGCAGCTATTTAAATTGGTATCAGCAGAAACCAGGGA
   T  I  T  C  R  T  S  Q  S  I  S  S  Y  L  N  W  Y  Q  Q  K  P  G AAGCCCCTAAACTCCTGATCTATGCTGCATCCAGTTTGCAAAGTGGGGTCCCATCAAGGTTCAGTGG
   K  A  P  K  L  L  I  Y  A  A  S  S  L  Q  S  G  V  P  S  R  F  S  G CAGTGGATCTGGGACAGATTTCACTCTCACCATCAGCGGTCTGCAACCTGAAGATTTTGCAACCTAC
   S  G  S  G  T  D  F  T  L  T  I  S  G  L  Q  P  E  D  F  A  T  Y
                                                              BsiWI
  TACTGTCAACAGAGTTACAGTATGCCTGCCTTTGGCCAGGGGACCAAGCTGGAGATCAAACGTACG
   Y  C  Q  Q  S  Y  S  M  P  A  F  G  Q  G  T  K  L  E  I  K  R  T
```

The amino acid sequence of the 23K12 Kappa LC variable region is as follows, with specific domains identified below (CDR sequences defined according to Kabat methods):

M D M R V L A Q L L G L L L L W L R G A R C    VK leader (SEQ ID NO: 57)

D I Q M T Q S P S S L S A S V G D R V T I T C    FR1 (SEQ ID NO: 58)

R T S Q S I S S Y L N    CDR1 (SEQ ID NO: 92)

W Y Q Q K P G K A P K L L I Y    FR2 (SEQ ID NO: 93)

A A S S L Q S G V P S R F    CDR2 (SEQ ID NO: 94)

S G S G S G T D F T L T I S G L Q P E D F A T Y Y C    FR3 (SEQ ID NO: 95)

Q Q S Y S M P A    CDR3 (SEQ ID NO: 96)

F G Q G T K L E I K    FR4 (SEQ ID NO: 114)

R T    Start of Kappa LC constant region

The 23K12 Gamma HC variable region was cloned as a Hind III to Xho 1 fragment, and is encoded by the following polynucleotide sequences and SEQ ID NO: 97 (top) and SEQ ID NO: 98 (bottom).

```
HindIII
AAGCTTCCACCATGGAGTTGGGGCTGTGCTGGGTTTTCCTTGTTGCTATTTTAAAAGGTGTCCAGT
TTCGAAGGTGGTACCTCAACCCCGACACGACCCAAAAGGAACAACGATAAAATTTTCCACAGGTCA GTGAGGTGCAGCTGGTGGAGTCTGGGGGAGGCTTGGTCCAGCCTGGGGGGTCCCTGAGAATCTCCT
CACTCCACGTCGACCACCTCAGACCCCCTCCGAACCAGGTCGGACCCCCCAGGGACTCTTAGAGGA GTGCAGCCTCTGGATTCACCGTCAGTAGCAACTACATGAGTTGGGTCCGCCAGGCTCCAGGGAAGG
CACGTCGGAGACCTAAGTGGCAGTCATCGTTGATGTACTCAACCCAGGCGGTCCGAGGTCCCTTCC GGCTGGAGTGGGTCTCAGTTATTTATAGTGGTGGTAGCACATACTACGCAGACTCCGTGAAGGGCA
CCGACCTCACCCAGAGTCAATAAATATCACCACCATCGTGTATGATGCGTCTGAGGCACTTCCCGT
```

-continued
```
GATTCTCCTTCTCCAGAGACAACTCCAAGAACACAGTGTTTCTTCAAATGAACAGCCTGAGAGCCG
CTAAGAGGAAGAGGTCTCTGTTGAGGTTCTTGTGTCACAAAGAAGTTTACTTGTCGGACTCTCGGC AGGACACGGCTGTGTATTACTGTGCGAGATGTCTGAGCAGGATGCGGGGTTACGGTTTAGACGTCT
TCCTGTGCCGACACATAATGACACGCTCTACAGACTCGTCCTACGCCCAATGCCAAATCTGCAGA XhoI
GGGGCCAAGGGACCACGGTCACCGTCTCGAG
CCCCGGTTCCCTGGTGCCAGTGGCAGAGCTC
```

The translation of the 23K12 Gamma HC variable region is as follows, polynucleotide sequence (above, SEQ ID NO: 99, top), and amino acid sequence (below, corresponding to SEQ ID NO: 100):

```
HindIII
AAGCTTCCACCATGGAGTTGGGGCTGTGCTGGGTTTTCCTTGTTGCTATTTTAAAAGGTGTCCAG
              M   E   L   G   L   C   W   V   F   L   V   A   I   L   K   G   V TGTGAGGTGCAGCTGGTGGAGTCTGGGGGAGGCTTGGTCCAGCCTGGGGGGTCCCTGAGAATCTCC
  C   E   V   Q   L   V   E   S   G   G   G   L   V   Q   P   G   G   S   L   R   I   S TGTGCAGCCTCTGGATTCACCGTCAGTAGCAACTACATGAGTTGGGTCCGCCAGGCTCCAGGGAAG
  C   A   A   S   G   F   T   V   S   S   N   Y   M   S   W   V   R   Q   A   P   G   K GGGCTGGAGTGGGTCTCAGTTATTTATAGTGGTGGTAGCACATACTACGCAGACTCCGTGAAGGGC
  G   L   E   W   V   S   V   I   Y   S   G   G   S   T   Y   Y   A   D   S   V   K   G AGATTCTCCTTCTCCAGAGACAACTCCAAGAACACAGTGTTTCTTCAAATGAACAGCCTGAGAGCC
  R   F   S   F   S   R   D   N   S   K   N   T   V   F   L   Q   M   N   S   L   R   A GAGGACACGGCTGTGTATTACTGTGCGAGATGTCTGAGCAGGATGCGGGGTTACGGTTTAGACGTC
  E   D   T   A   V   Y   Y   C   A   R   C   L   S   R   M   R   G   Y   G   L   D   V XhoI
TGGGGCCAAGGGACCACGGTCACCGTCTCGAG
  W   G   Q   G   T   T   V   T   V   S
```

The amino acid sequence of the 23K12 Gamma HC variable region is as follows, with specific domains identified below (CDR sequences defined according to Kabat methods):

M E L G L C W V F L V A I L K G V Q C          VH leader (SEQ ID NO: 101)

E V Q L V E S G G G L V Q P G G S L R I S C A A S G F T V S          FR1 (SEQ ID NO: 102)

S N Y M S          CDR1 (SEQ ID NO: 103)

W V R Q A P G K G L E W V S          FR2 (SEQ ID NO: 104)

V I Y S G G S T Y Y A D S V K          CDR2 (SEQ ID NO: 105)

G R F S F S R D N S K N T V F L Q M N S L R A E D T A V Y Y C A R          FR3 (SEQ ID NO: 106)

C L S R M R G Y G L D V          CDR3 (SEQ ID NO: 107)

W G Q G T T V T V S          FR4 (SEQ ID NO: 108)

WGQGTTVTVSS          Long FR4 (SEQ ID NO: 111)

Example 3

Identification of Conserved Antibody Variable Regions

The amino acid sequences of the three antibody Kappa LC and Gamma HC variable regions were aligned to identify conserved regions and residues, as shown below.

Amino acid sequence alignment of the Kappa LC variable regions of the three clones (SEQ ID NOs 673-675, respectively, in order of appearance):

|  |  |  |  |  |  |  |  |  | 10 |  |  |  |  |  |  |  | 20 |  |  |  |
|---|---|---|---|---|---|---|---|---|---|---|---|---|---|---|---|---|---|---|---|---|
| Translation of mp 73 21B15 | A | S | T | M | D | M | R | V | L | A | Q | L | L | G | L | L | L | L | W | L | R | G | A |
| Translation of mp 147 8I10 | A | S | T | M | D | M | R | V | L | A | Q | L | L | G | L | L | L | L | W | L | R | G | A |
| Translation of mp 137 23K12 | A | S | T | M | D | M | R | V | L | A | Q | L | L | G | L | L | L | L | W | L | R | G | A |

|  |  |  |  |  | 30 |  |  |  |  |  |  |  |  | 40 |  |  |  |  |  |  |
|---|---|---|---|---|---|---|---|---|---|---|---|---|---|---|---|---|---|---|---|---|
| Translation of mp 73 21B15 | R | C | D | I | Q | V | T | Q | S | P | S | S | L | S | A | S | V | G | D | R | V | T | I |
| Translation of mp 147 8I10 | R | C | D | I | Q | M | T | Q | S | P | S | S | L | S | A | S | V | G | D | R | V | T | I |
| Translation of mp 137 23K12 | R | C | D | I | Q | M | T | Q | S | P | S | S | L | S | A | S | V | G | D | R | V | T | I |

|  |  |  |  | 50 |  |  |  |  |  |  |  | 60 |  |  |  |  |  |  |  |  |
|---|---|---|---|---|---|---|---|---|---|---|---|---|---|---|---|---|---|---|---|---|
| Translation of mp 73 21B15 | T | C | R | A | S | Q | N | I | Y | K | Y | L | N | W | Y | Q | Q | R | P | G | K | A | P |
| Translation of mp 147 8I10 | T | C | R | A | S | Q | N | I | Y | K | Y | L | N | W | Y | Q | Q | R | P | G | K | A | P |
| Translation of mp 137 23K12 | T | C | R | T | S | Q | S | I | S | S | Y | L | N | W | Y | Q | Q | K | P | G | K | A | P |

|  | 70 |  |  |  |  |  |  | 80 |  |  |  |  |  |  |  | 90 |  |  |  |  |
|---|---|---|---|---|---|---|---|---|---|---|---|---|---|---|---|---|---|---|---|---|---|
| Translation of mp 73 21B15 | K | G | L | I | S | A | A | S | G | L | Q | S | G | V | P | S | R | F | S | G | S | G | S |
| Translation of mp 147 8I10 | K | G | L | I | S | A | A | S | G | L | Q | S | G | V | P | S | R | F | S | G | S | G | S |
| Translation of mp 137 23K12 | K | L | L | I | Y | A | A | S | S | L | Q | S | G | V | P | S | R | F | S | G | S | G | S |

|  |  |  |  |  |  | 100 |  |  |  |  |  |  |  | 110 |  |  |  |  |  |  |
|---|---|---|---|---|---|---|---|---|---|---|---|---|---|---|---|---|---|---|---|---|---|
| Translation of mp 73 21B15 | G | T | D | F | T | L | T | I | T | S | L | Q | P | E | D | F | A | T | Y | Y | C | Q | Q |
| Translation of mp 147 8I10 | G | T | D | F | T | L | T | I | T | S | L | Q | P | E | D | F | A | T | Y | Y | C | Q | Q |
| Translation of mp 137 23K12 | G | T | D | F | T | L | T | I | S | G | L | Q | P | E | D | F | A | T | Y | Y | C | Q | Q |

|  |  |  |  |  | 120 |  |  |  |  |  |  |  |  | 130 |  |  |  |  |  |
|---|---|---|---|---|---|---|---|---|---|---|---|---|---|---|---|---|---|---|---|---|
| Translation of mp 73 21B15 | S | Y | S | P | P | L | T | F | G | G | G | T | R | V | D | I | K | R | T |
| Translation of mp 147 8I10 | S | Y | S | P | P | L | T | F | G | G | G | T | R | V | E | I | K | R | T |
| Translation of mp 137 23K12 | S | Y | S | M | P | — | A | F | G | Q | G | T | K | L | E | I | K | R | T |

Amino acid sequence alignment of the Gamma HC variable regions of the three clones (SEQ ID NOs 676-678, respectively, in order of appearance):

| | | | | | | | | | 10 | | | | | | | | | | 20 |
|---|---|---|---|---|---|---|---|---|---|---|---|---|---|---|---|---|---|---|---|
| Translation of mp S1 21B15 | A | S | T | M | K | H | L | W | F | F | L | L | L | V | A | A | P | S | W | V |
| Translation of mp 145 23K12 | A | S | T | M | E | L | G | L | C | W | V | F | L | V | A | I | L | K | G | V |
| Translation of mp 153 8I10 | A | S | T | M | K | H | L | W | F | F | L | L | L | V | A | A | P | S | W | V |

| | | | | | | | | | 30 | | | | | | | | | | 40 |
|---|---|---|---|---|---|---|---|---|---|---|---|---|---|---|---|---|---|---|---|
| Translation of mp 81 21B15 | L | S | Q | V | Q | L | Q | E | S | G | P | G | L | V | K | P | S | E | T | L |
| Translation of mp 145 23K12 | Q | C | E | V | Q | L | V | E | S | G | G | G | L | V | Q | P | G | G | S | L |
| Translation of mp 153 8I10 | L | S | Q | V | Q | L | Q | E | S | G | P | G | L | V | K | P | S | E | T | L |

| | | | | | | | | | 50 | | | | | | | | | | 60 |
|---|---|---|---|---|---|---|---|---|---|---|---|---|---|---|---|---|---|---|---|
| Translation of mp 81 21B15 | S | L | T | C | T | V | S | G | S | S | I | S | N | Y | Y | W | S | W | I | R |
| Translation of mp 145 23K12 | R | I | S | C | A | A | S | G | F | T | V | S | S | N | Y | M | S | W | V | R |
| Translation of mp 153 8I10 | S | L | T | C | T | V | S | G | S | S | I | S | N | Y | Y | W | S | W | I | R |

| | | | | | | | | | 70 | | | | | | | | | | 80 |
|---|---|---|---|---|---|---|---|---|---|---|---|---|---|---|---|---|---|---|---|
| Translation of mp 81 21B15 | Q | S | P | G | K | G | L | E | W | I | G | F | I | Y | Y | G | G | N | T | K |
| Translation of mp 145 23K12 | Q | A | P | G | K | G | L | E | W | V | S | V | I | Y | S | G | G | S | T | Y |
| Translation of mp 153 8I10 | Q | S | P | G | K | G | L | E | W | I | G | F | I | Y | Y | G | G | N | T | K |

| | | | | | | | | | 90 | | | | | | | | | | 100 |
|---|---|---|---|---|---|---|---|---|---|---|---|---|---|---|---|---|---|---|---|
| Translation of mp 81 21B15 | Y | N | P | S | L | K | S | R | V | T | I | S | Q | D | T | S | K | S | Q | V |
| Translation of mp 145 23K12 | Y | A | D | S | V | K | G | R | F | S | F | S | R | D | N | S | K | N | T | V |
| Translation of mp 153 8I10 | Y | N | P | S | L | K | S | R | V | T | I | S | Q | D | T | S | K | S | Q | V |

| | | | | | | | | | 110 | | | | | | | | | | 120 |
|---|---|---|---|---|---|---|---|---|---|---|---|---|---|---|---|---|---|---|---|
| Translation of mp 81 21B15 | S | L | T | M | S | S | V | T | A | A | E | S | A | V | Y | F | C | A | R | A |
| Translation of mp 145 23K12 | F | L | Q | M | N | S | L | R | A | E | D | T | A | V | Y | Y | C | A | R | C |
| Translation of mp 153 8I10 | S | L | T | M | S | S | V | T | A | A | E | S | A | V | Y | F | C | A | R | A |

| | | | | | | | | | 130 | | | | | | | | | | 140 |
|---|---|---|---|---|---|---|---|---|---|---|---|---|---|---|---|---|---|---|---|
| Translation of mp 81 21B15 | S | C | S | G | G | Y | C | I | L | D | Y | W | G | Q | T | L | V | T | V | S |
| Translation of mp 145 23K12 | L | S | R | M | R | G | Y | G | L | D | V | W | G | Q | T | T | V | T | V | S |
| Translation of mp 153 8I10 | S | C | S | G | G | Y | C | I | L | D | Y | W | G | Q | T | L | V | T | V | S |

Clones 8I10 and 21B15 came from two different donors, yet they have the same exact Gamma HC and differ in the Kappa LC by only one amino acid at position 4 in the framework 1 region (amino acids M versus V, see above), (excluding the D versus E wobble position in framework 4 of the Kappa LC).

Sequence comparisons of the variable regions of the antibodies revealed that the heavy chain of clone 8i10 was derived from germline sequence IgHV4 and that the light chain was derived from the germline sequence IgKV1.

Sequence comparisons of the variable regions of the antibodies revealed that the heavy chain of clone 21B15 was derived from germline sequence IgHV4 and that the light chain was derived from the germline sequence IgKV1.

Sequence comparisons of the variable regions of the antibodies revealed that the heavy chain of clone 23K12 was derived from germline sequence IgHV3 and that the light chain was derived from the germline sequence IgKV1.

Example 4

Production and Characterization of M2 Antibodies

Figure 1:
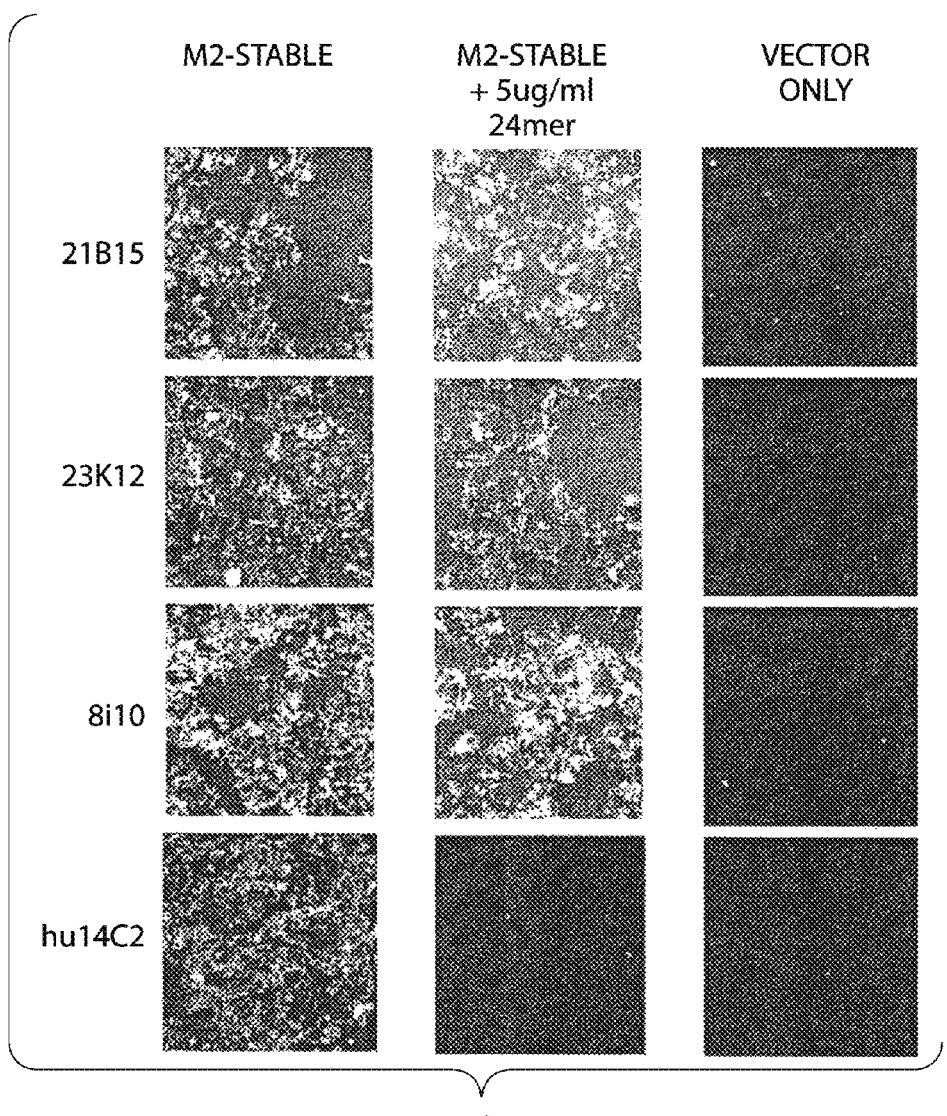
FIG. 1 shows the binding of three antibodies of the present invention and control hu14C2 antibody to 293-HEK cells transfected with an M2 expression construct or control vector, in the presence or absence of free M2 peptide.
Figure 2A:
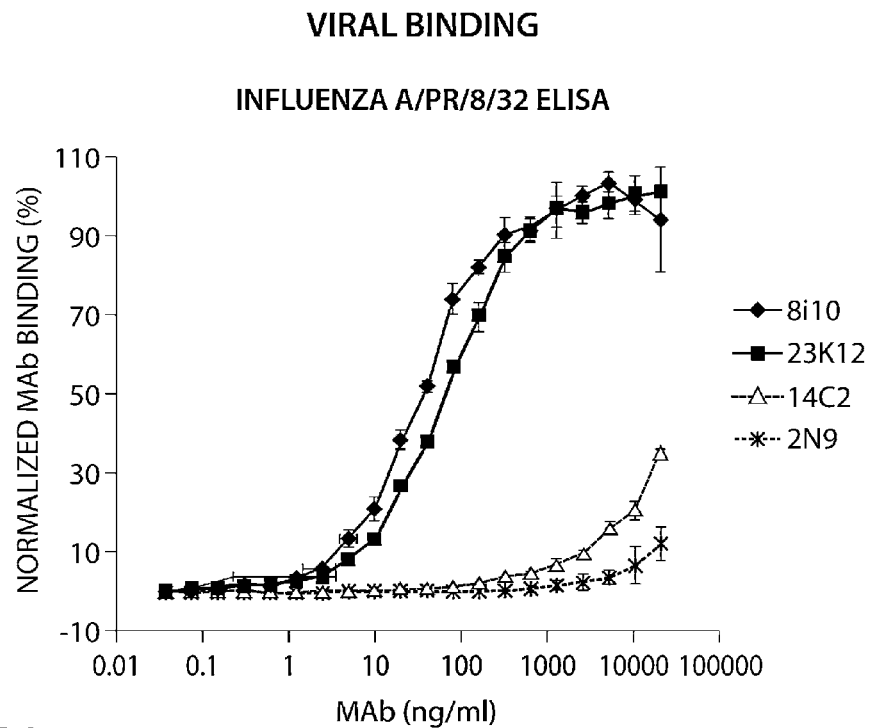
FIGS. 2A and B are graphs showing human monoclonal antibody binding to influenza A/Puerto Rico/8/32.
Figure 2B:
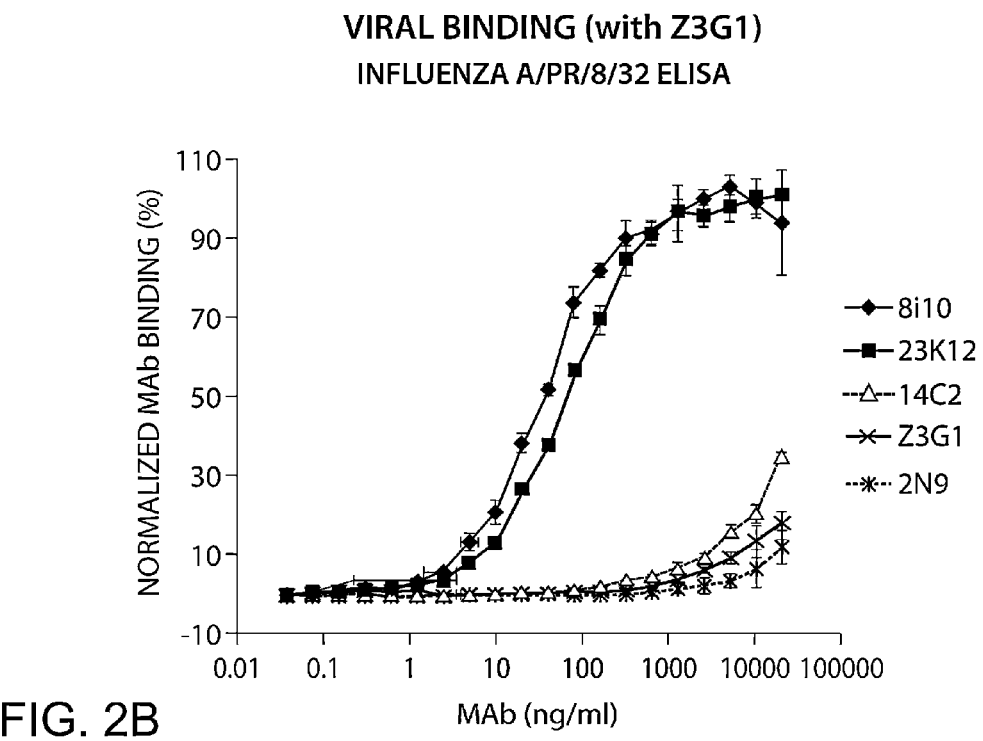
Figures 1, 3B:
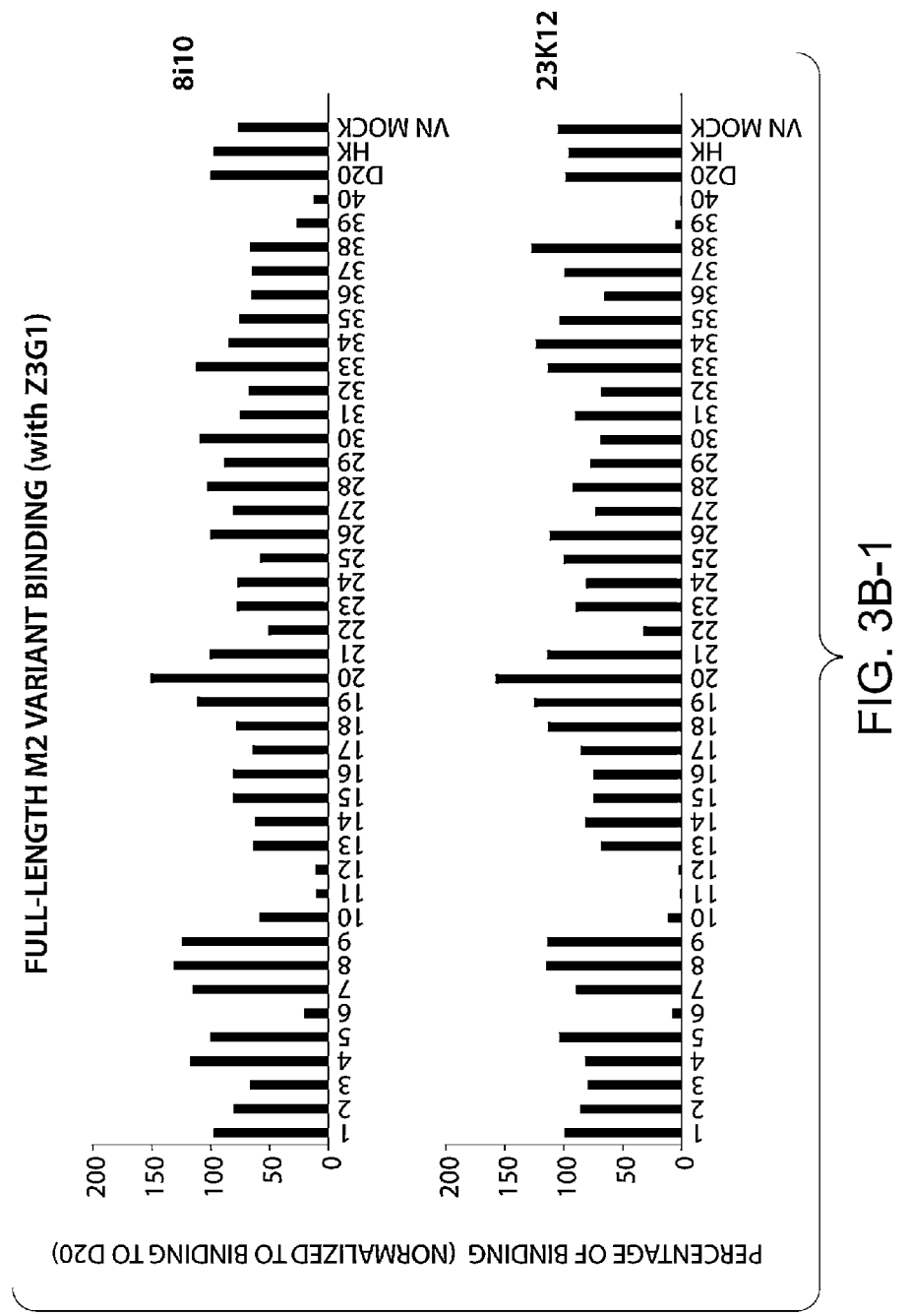
FIGS. 3B and C are bar charts showing binding of human monoclonal anti-influenza antibody binding to M2 variants shown in FIG. 3A.
Figures 2, 3B:
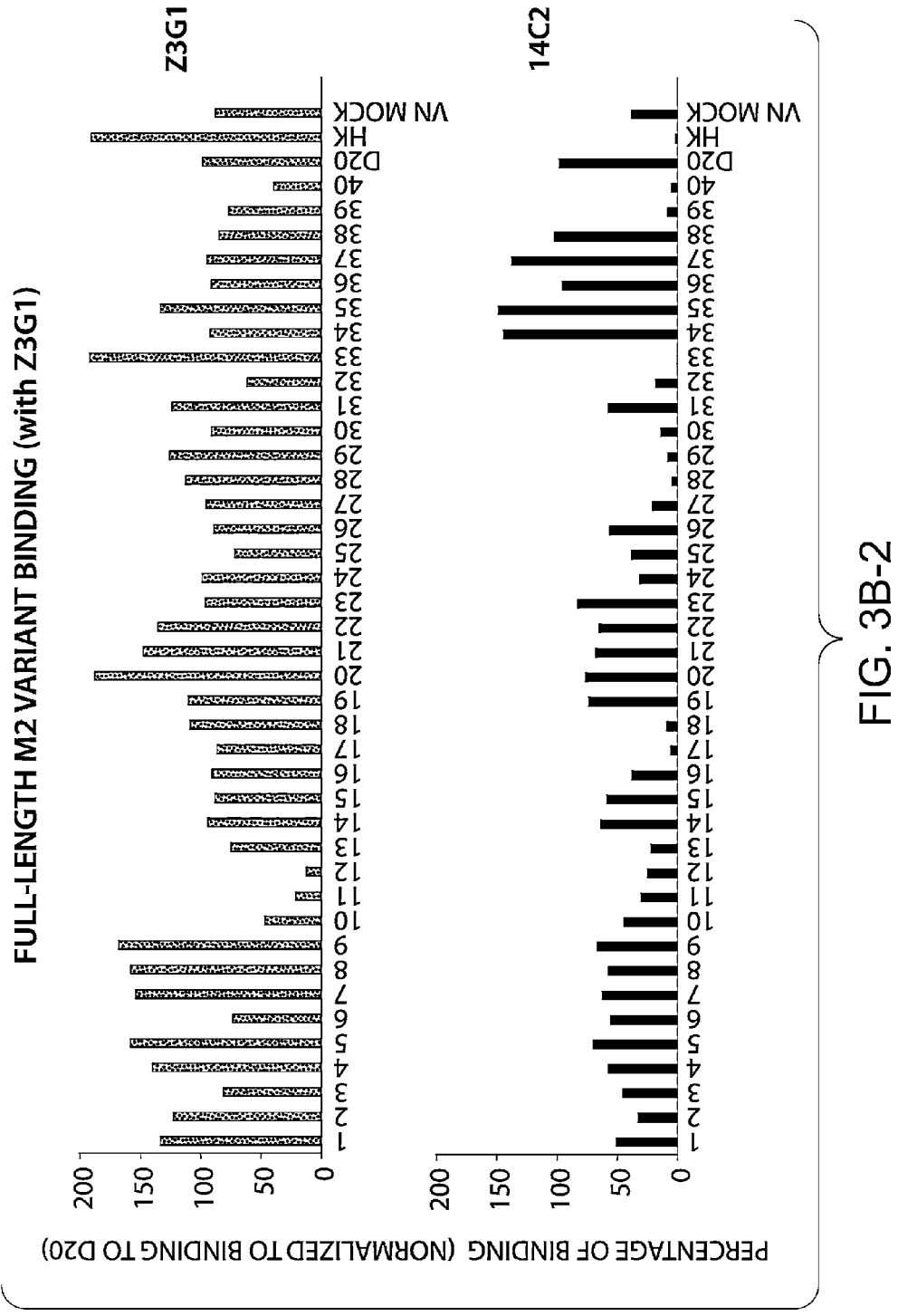
Figures 1, 3C:
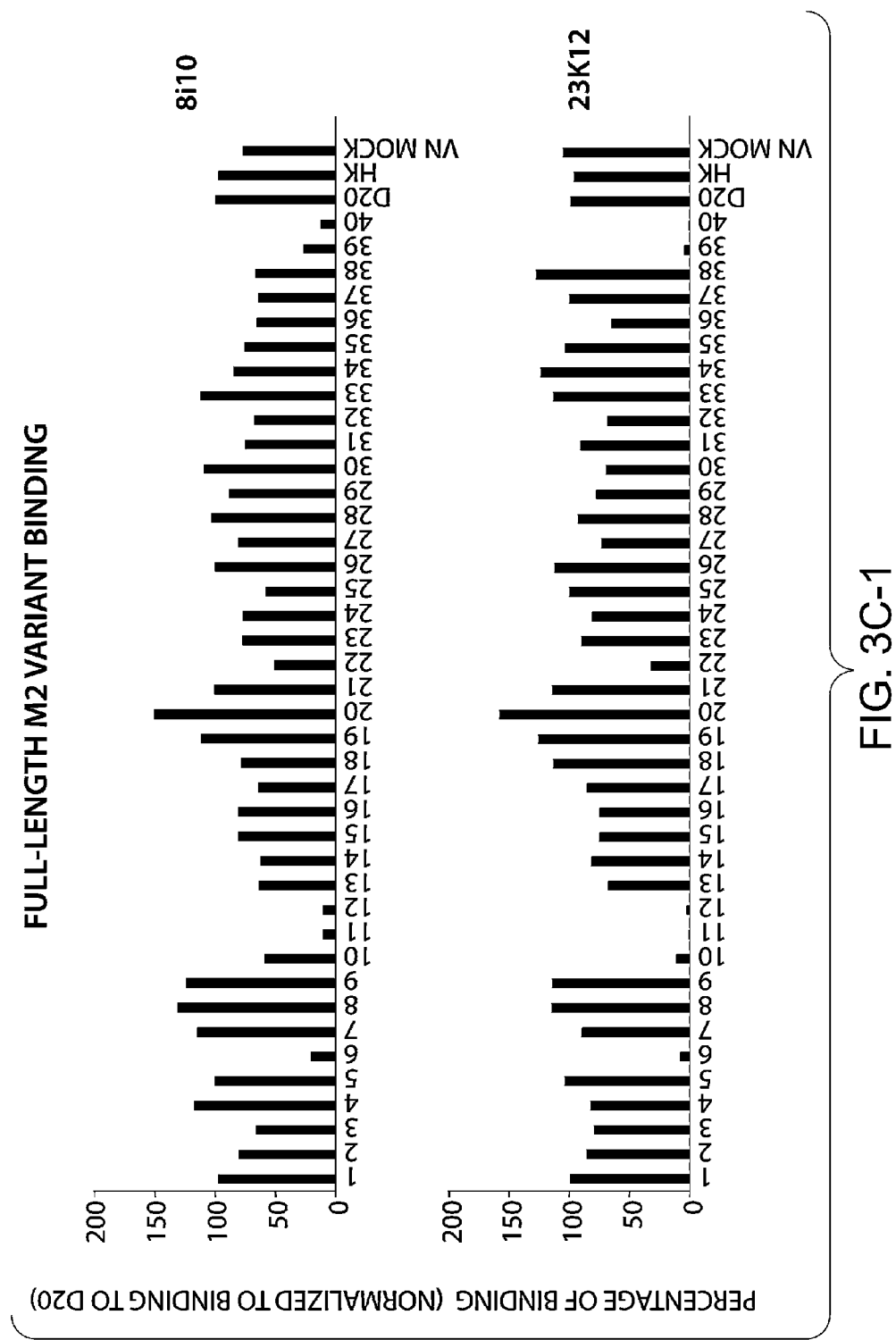
Figures 2, 3C:
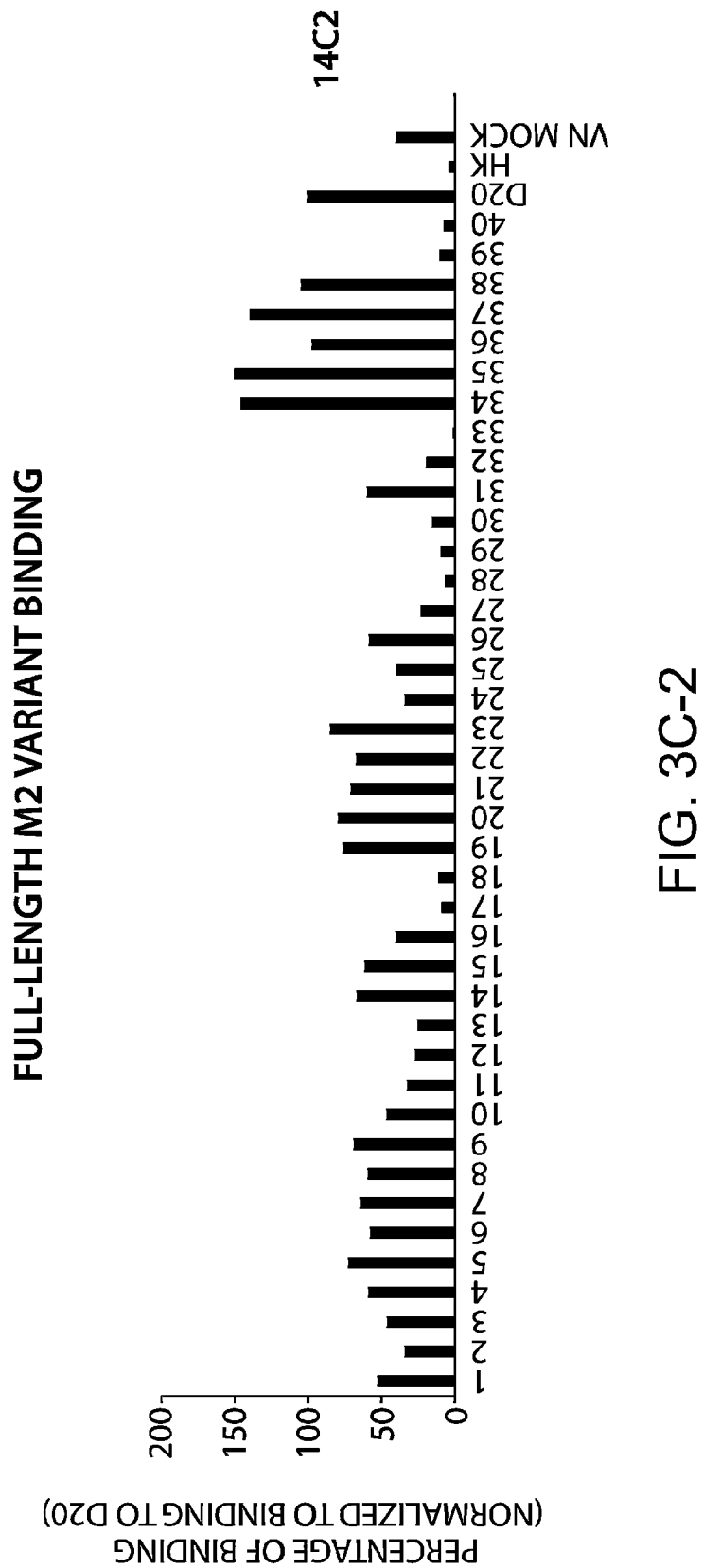
FIG. 3A is a chart showing amino acid sequences of extracellular domains of M2 variants (SEQ ID NOS 1-3, 679 & 5-40, respectively, in order of appearance).
Figure 4A:
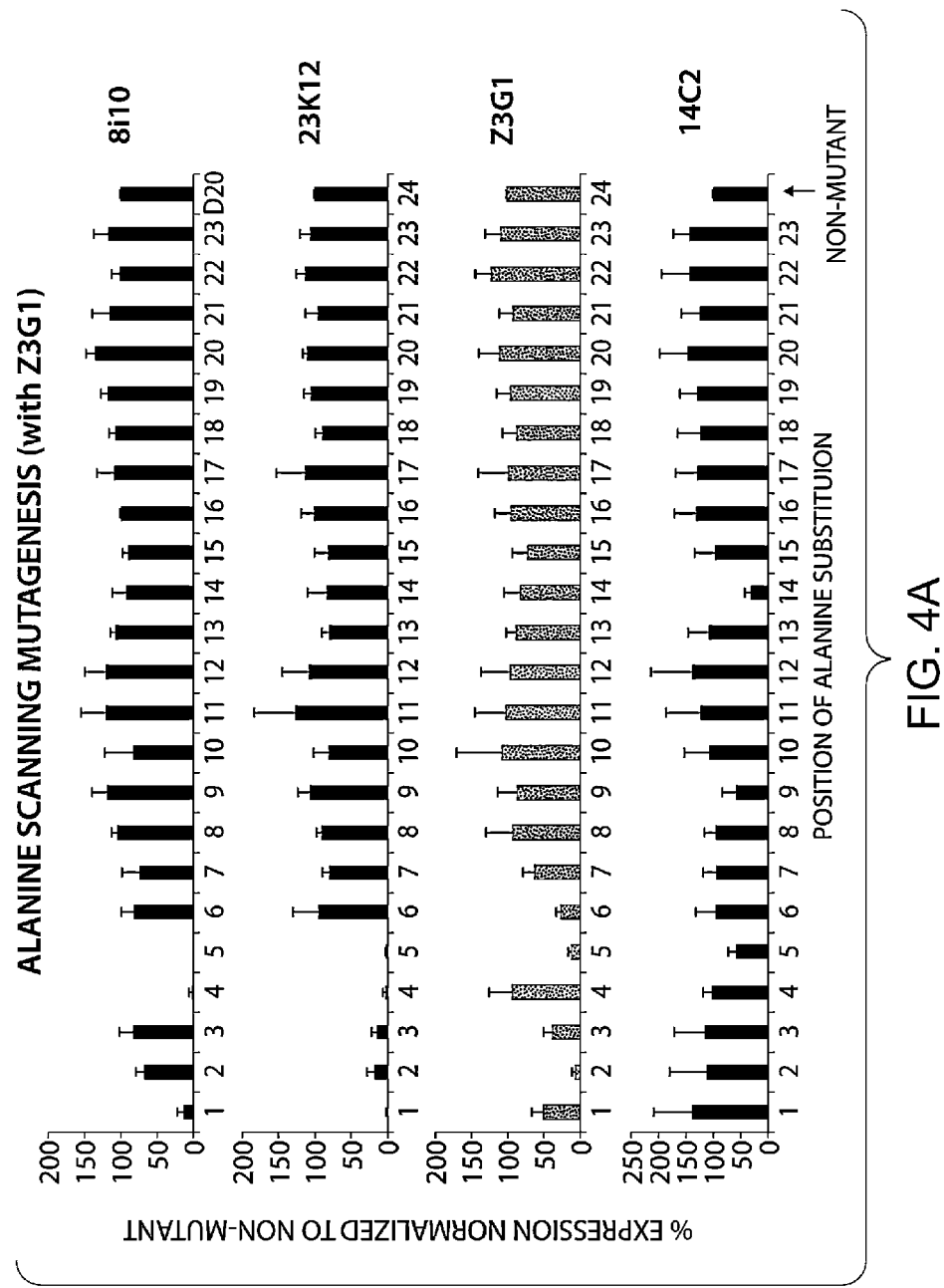
FIGS. 4A and B are bar charts showing binding of human monoclonal anti-influenza antibody binding to M2 peptides subjected to alanine scanning mutagenesis.
Figure 4B:
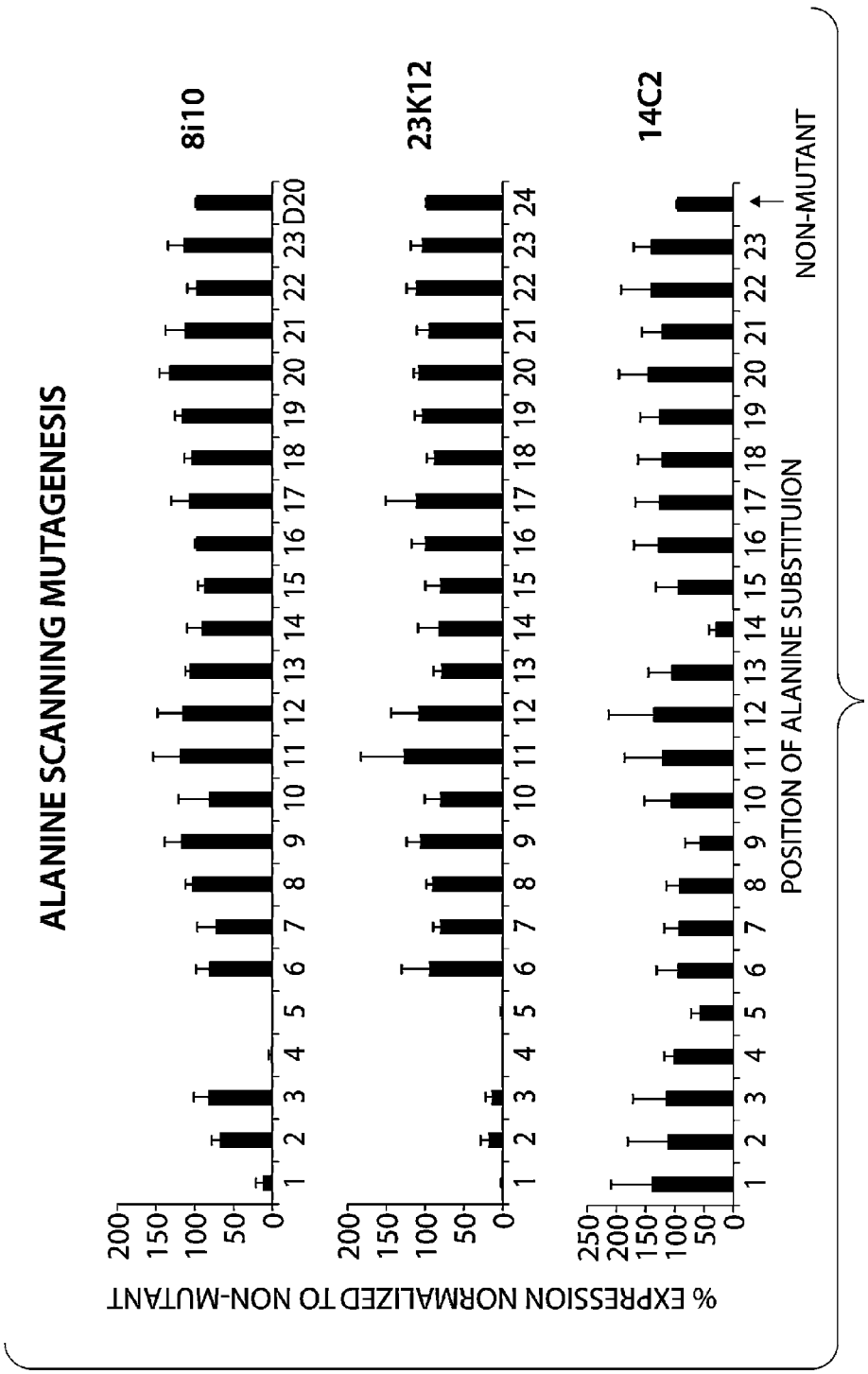
Figure 5:
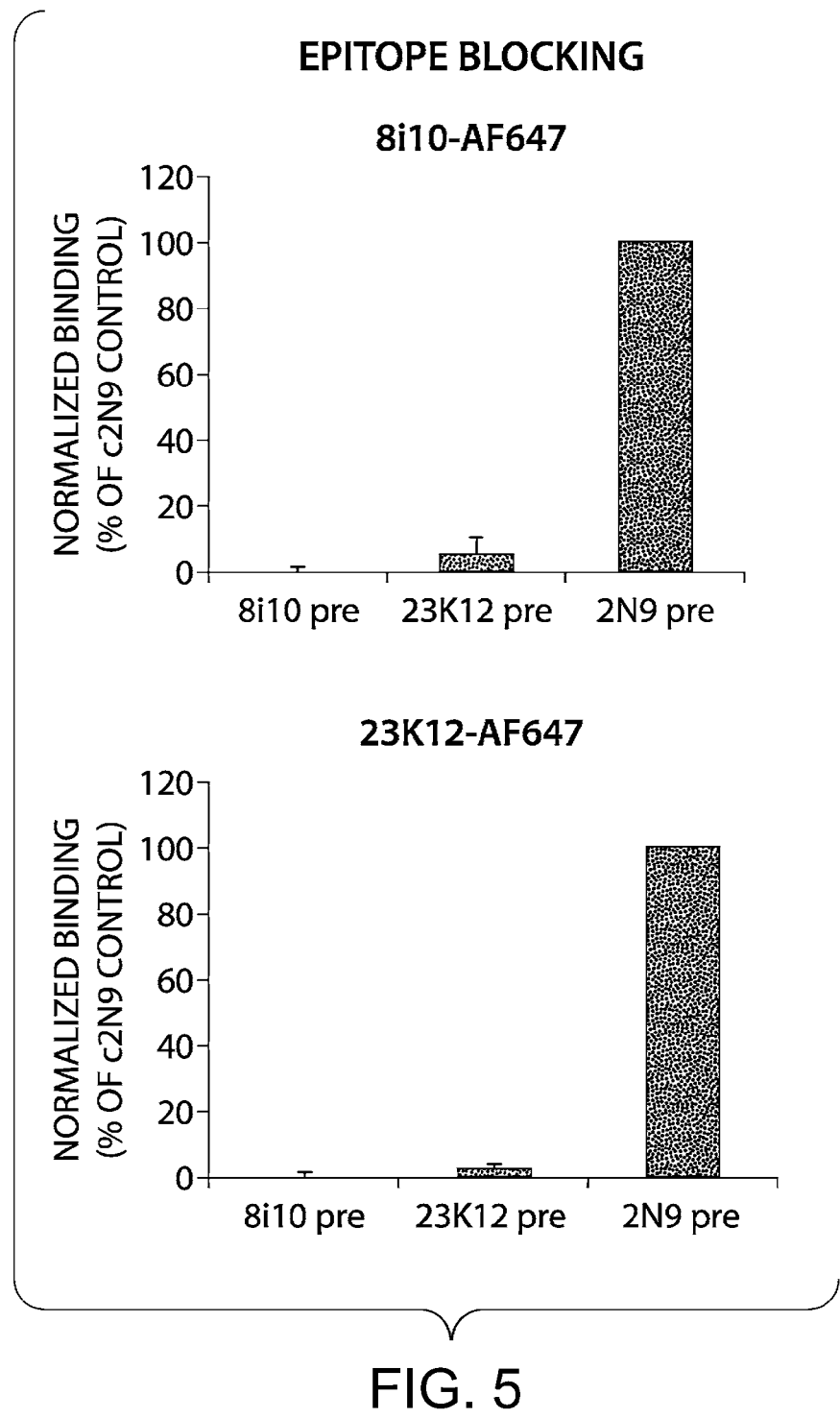
FIG. 5 is a series of bar charts showing binding of MAbs 8i10 and 23K12 to M2 protein representing influenza strain A/HK/483/1997 sequence that was stably expressed in the CHO cell line DG44.
Figure 8:
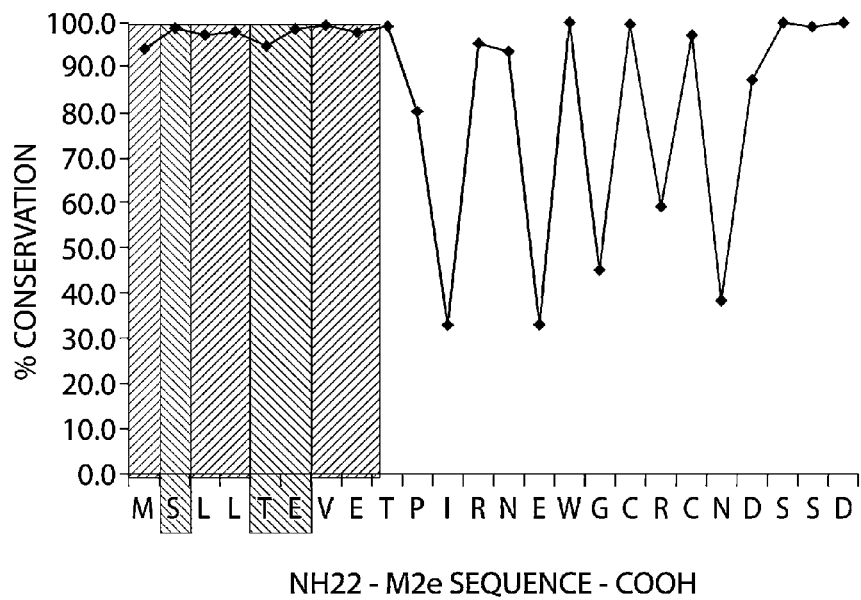
FIG. 8 is an illustration showing the anti-M2 antibodies bind a highly conserved region in the N-Terminus of M2e (SEQ ID NO: 19).
Figure 9:
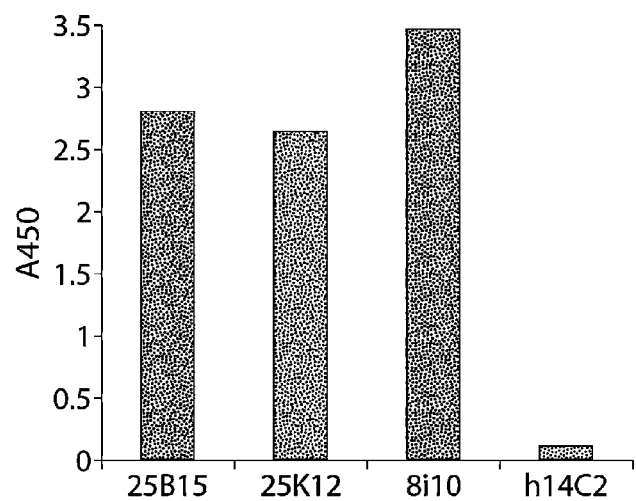
FIG. 9 is a graph showing anti-M2 rHMAb clones from crude supernatant bound to influenza on ELISA, whereas the control anti-M2e mAb 14C2 did not readily bind virus.

The antibodies described above were produced in milligram quantities by larger scale transient transfections in 293 PEAK cells. Crude un-purified antibody supernatants were used to examine antibody binding to influenza A/Puerto Rico/8/1932 (PR8) virus on ELISA plates, and were compared to the binding of the control antibody 14C2, which was also produced by larger scale transient transfection. The anti-M2 recombinant human monoclonal antibodies bound to influenza while the control antibody did not (FIG. 9).

Figure 10:
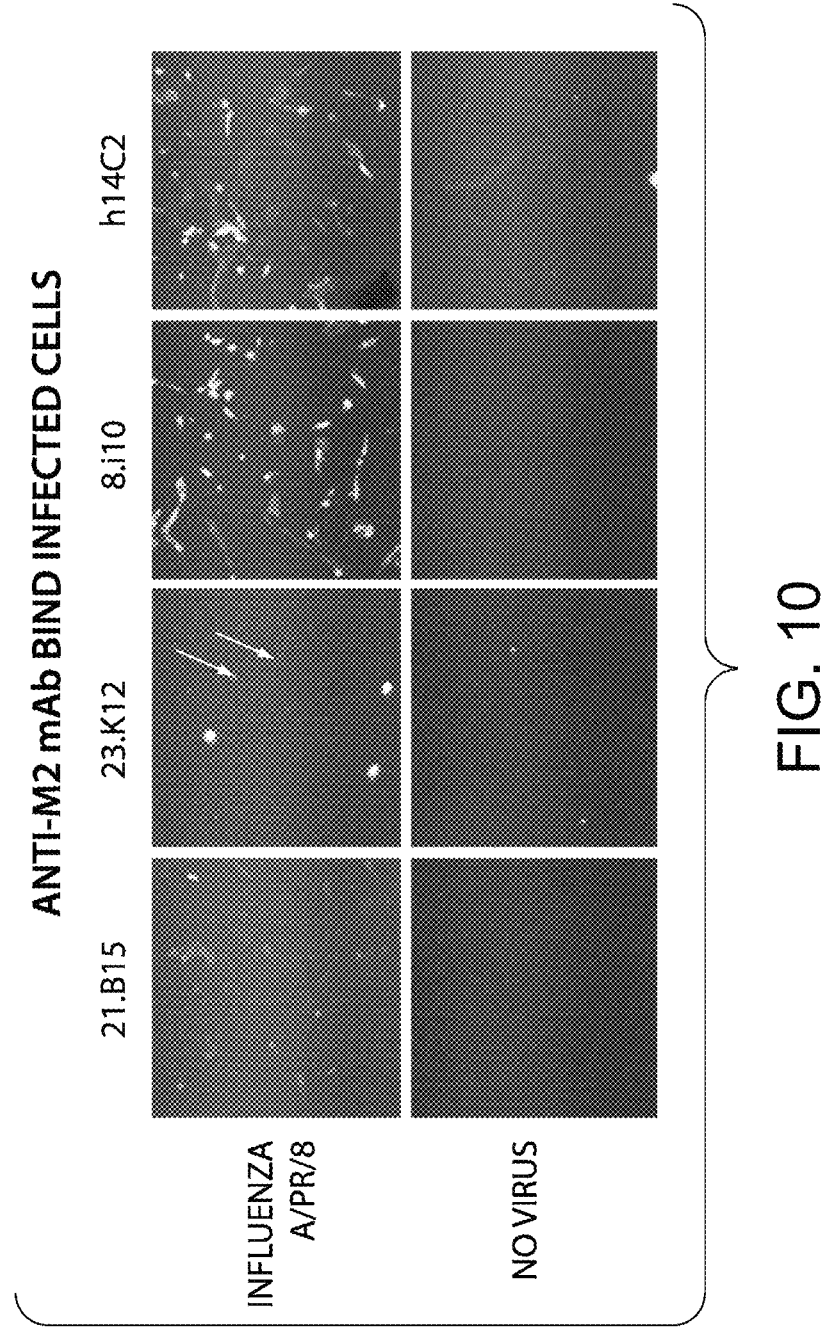
FIG. 10 is a series of photographs showing anti-M2 rHMAbs bound to cells infected with influenza. MDCK cells were or were not infected with influenza A/PR/8/32 and Ab binding from crude supernatant was tested 24 hours later. Data were gathered from the FMAT plate scanner.

Binding was also tested on MDCK cells infected with the PR8 virus (FIG. 10). The control antibody 14C2 and the three anti M2E clones: 8I10, 21B15 and 23K12, all showed specific binding to the M2 protein expressed on the surface of PR8-infected cells. No binding was observed on uninfected cells.

Figure 11:
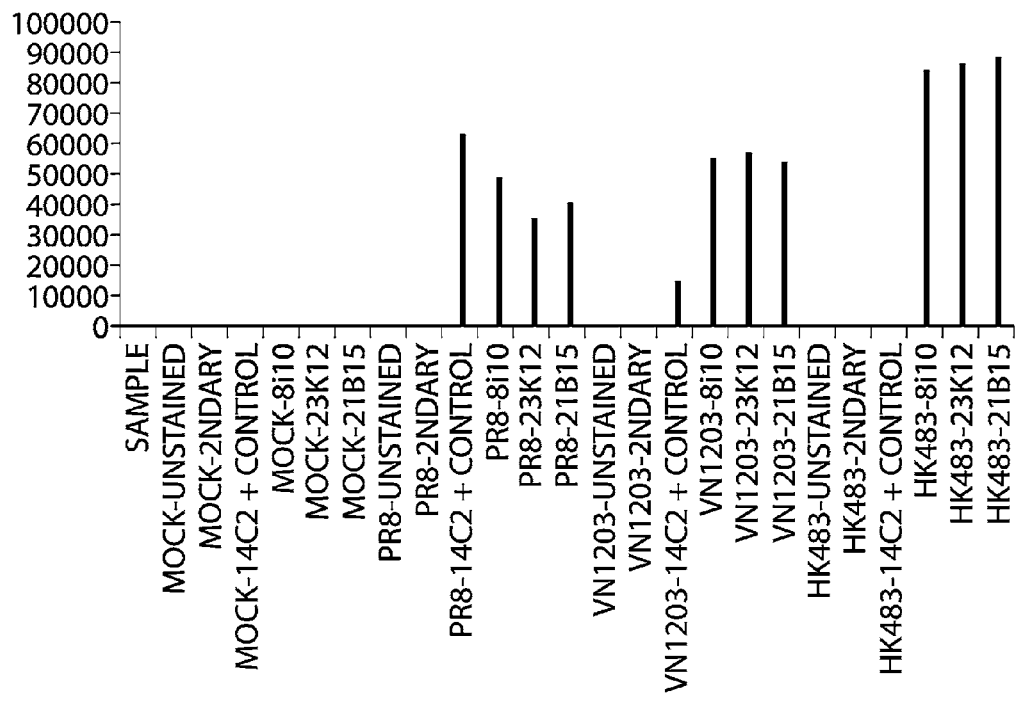
FIG. 11 is a graph showing anti-M2 rHMAb clones from crude supernatant bound to cells transfected with the influenza subtypes H3N2, HK483, and VN1203 M2 proteins. Plasmids encoding full length M2 cDNAs corresponding to influenza strains H3N2, HK483, and VN1203, as well as a mock plasmid control, were transiently transfected into 293 cells. The 14C2, 8i10, 23K12, and 21B15 mABs were tested for binding to the transfectants, and were detected with an AF647-conjugated anti-human IgG secondary antibody. Shown are the mean fluorescence intensities of the specific mAB bound after FACS analysis.

The antibodies were purified over protein A columns from the supernatants. FACs analysis was performed using purified antibodies at a concentration of 1 ug per ml to examine the binding of the antibodies to transiently transfected 293 PEAK cells expressing the M2 proteins on the cell surface. Binding was measured testing binding to mock transfected cells and cells transiently transfected with the Influenza subtype H3N2, A/Vietnam/1203/2004 (VN1203), or A/Hong Kong/483/1997 HK483 M2 proteins. As a positive control the antibody 14C2 was used. Unstained and secondary antibody alone controls helped determined background. Specific staining for cells transfected with the M2 protein was observed for all three clones. Furthermore, all three clones bound to the high path strains A/Vietnam/1203/2004 and A/Hong Kong/483/1997 M2 proteins very well, whereas the positive control 14C2 which bound well to H3N2 M2 protein, bound much weaker to the A/Vietnam/1203/2004 M2 protein and did not bind the A/Hong Kong/483/1997 M2 protein. See FIG. 11.

Antibodies 21B15, 23K12, and 8I10 bound to the surface of 293-HEK cells stably expressing the M2 protein, but not to vector transfected cells (see FIG. 1). In addition, binding of these antibodies was not competed by the presence of 5 mg/ml 24-mer M2 peptide, whereas the binding of the control chimeric mouse V-region/human IgG1 kappa 14C2 antibody (hu14C2) generated against the linear M2 peptide was completely inhibited by the M2 peptide (see FIG. 1). These data confirm that these antibodies bind to conformational epitopes present in M2e expressed on the cell or virus surface, as opposed to the linear M2e peptide.

Example 5

Viral Binding of Human Anti-Influenza Monoclonal Antibodies

UV-inactivated influenza A virus (A/PR/8/34) (Applied Biotechnologies) was plated in 384-well MaxiSorp plates (Nunc) at 1.2 μg/ml in PBS, with 25 and was incubated at 4° C. overnight. The plates were then washed three times with PBS, and blocked with 1% Nonfat dry milk in PBS, 50 μl/well, and then were incubated at room temp for 1 hr. After a second wash with PBS, MAbs were added at the indicated concentrations in triplicate, and the plates were incubated at room temp for 1 hour. After another wash with PBS, to each well was added 25 μl of a 1/5000 dilution of horseradish peroxidase (HRP) conjugated goat anti-human IgG Fc (Pierce) in PBS/1% Milk, and the plates were left at room temp for 1 hr. After the final PBS wash, the HRP substrate 1-Step™ Ultra-TMB-ELISA (Pierce) was added at 25 μl/well, and the reaction proceeded in the dark at room temp. The assay was stopped with 25 μl/well 1N $H_2SO_4$, and light absorbance at 450 nm (A450) was read on a SpectroMax Plus plate reader. Data are normalized to the absorbance of MAb 8I10 binding at 10 μg/ml. Results are shown in FIGS. 2A and 2B.

Example 6

Binding of Human Anti-Influenza Monoclonal Antibodies to Full-Length M2 Variants M2 variants (including those with a high pathology phenotype in vivo) were selected for analysis. See FIG. 3A for sequences.

M2 cDNA constructs were transiently transfected in HEK293 cells and analyzed as follows: To analyze the transient transfectants by FACS, cells on 10 cm tissue culture plates were treated with 0.5 ml Cell Dissociation Buffer (Invitrogen), and harvested. Cells were washed in PBS containing 1% FBS, 0.2% $NaN_3$ (FACS buffer), and resuspended in 0.6 ml FACS buffer supplemented with 100 μg/ml rabbit IgG. Each transfectant was mixed with the indicated MAbs at 1 μg/ml in 0.2 ml FACS buffer, with $5\times10^5$ to $10^6$ cells per sample. Cells were washed three times with FACS buffer, and each sample was resuspended in 0.1 ml containing 1 μg/ml alexafluor (AF) 647-anti human IgG H&L (Invitrogen). Cells were again washed and flow cytometry was performed on a FACSCanto device (Becton-Dickenson). The data is expressed as a percentage of the mean fluorescence of the M2-D20 transient transfectant. Data for variant binding are representative of 2 experiments. Data for alanine mutants are average readouts from 3 separate experiments with standard error. Results are shown in FIGS. 3B and 3C.

Example 7

Alanine Scanning Mutagenesis to Evaluate M2 Binding

To evaluate the antibody binding sites, alanine was substituted at individual amino acid positions as indicated by site-directed mutagenesis.

M2 cDNA constructs were transiently transfected in HEK293 cells and analyzed as described above in Example 6. Results are shown in FIGS. 4A and 4B. FIG. 8 shows that the epitope is in a highly conserved region of the amino terminus of the M2 polypeptide. As shown in FIGS. 4A, 4B and FIG. 8, the epitope includes the serine at position 2, the threonine at position 5 and the glutamic acid at position 6 of the M2 polypeptide.

Example 8

Epitope Blocking

To determine whether the MAbs 8I10 and 23K12 bind to the same site, M2 protein representing influenza strain A/HK/483/1997 sequence was stably expressed in the CHO (Chinese Hamster Ovary) cell line DG44. Cells were treated with Cell Dissociation Buffer (Invitrogen), and harvested. Cells were washed in PBS containing 1% FBS, 0.2% $NaN_3$ (FACS buffer), and resuspended at $10^7$ cells/ml in FACS buffer supplemented with 100 μg/ml rabbit IgG. The cells were pre-bound by either MAb (or the 2N9 control) at 10 μg/ml for 1 hr at 4° C., and were then washed with FACS buffer. Directly conjugated AF647-8I10 or -23K12 (labeled with the AlexaFluor® 647 Protein Labeling kit (Invitrogen) was then used to stain the three pre-blocked cell samples at 1 μg/ml for $10^6$ cells per sample. Flow cytometric analyses proceeded as before with the FACSCanto. Data are average readouts from 3 separate experiments with standard error. Results are shown in FIG. 5.

Example 9

Binding of Human Anti-Influenza Monoclonal Antibodies to M2 Variants and Truncated M2 Peptides The cross reactivity of mAbs 8i10 and 23K12 to other M2 peptide variants was assessed by ELISA. Peptide sequences are shown in FIGS. 6A and 6B. Additionally, a similar ELISA assay was used to determine binding activity to M2 truncated peptides.

In brief, each peptide was coated at 2 μg/mL to a flat bottom 384 well plate (Nunc) in 25 μL/well of PBS buffer overnight at 4° C. Plates were washed three times and blocked with 1% Milk/PBS for one hour at room temperature. After washing three times, MAb titers were added and incubated for one hour at room temperature. Diluted HRP conjugated goat anti-human immunoglobulin FC specific (Pierce) was added to each well after washing three times. Plates were incubated for one hour at room temperature and washed three times. 1-Step™ Ultra-TMB-ELISA (Pierce) was added at 25 μl/well, and the reaction proceeded in the dark at room temp.

The assay was stopped with 25 μl/well 1N H₂SO₄, and light absorbance at 450 nm (A450) was read on a SpectroMax Plus plate reader. Results are shown in FIGS. 6A and 6B.

Example 10

In Vivo Evaluation of the Ability of Human Anti-Influenza Monoclonal Antibodies to Protect from Lethal Viral Challenge The ability of antibodies, 23K12 and 8I10, to protect mice from lethal viral challenge with a high path avian influenza strain was tested.

Female BALB/c mice were randomized into 5 groups of 10. One day prior (Day −1 (minus one)) and two days post infection (Day +2 (plus two)), 200 ug of antibody was given via 200 ul intra-peritoneal injection. On Day 0 (zero), an approximate LD90 (lethal dose 90) of A/Vietnam/1203/04 influenza virus, in a volume of 30 μl was given intra-nasally. Survival rate was observed from Day 1 through Day 28 post-infection. Results are shown in FIG. 7.

Example 11

Characterization of M2 Antibodies TCN-032 (8I10), 21B15, TCN-031 (23K12), 3241_G23, 3244_I10, 3243_J07, 3259_J21, 3245_O19, 3244_H04, 3136_G05, 3252_C13, 3255_J06, 3420_I23, 3139_P23, 3248_P18, 3253_P10, 3260_D19, 3362_B11, and 3242_P05

FACS
Full length M2 cDNA (A/Hong Kong/483/97) were synthesized (Blue Heron Technology) and cloned into the plasmid vector pcDNA3.1 which was then transfected into CHO cells with Lipofectamine (Invitrogen) to create a stable pool of CHO-HK M2-expressing cells. For the panel of anti-M2 Mabs, 20 μl samples of supernatant from transient transfections from each of the IgG heavy and light chain combinations was used to stain the CHO-HK M2 stable cell line. Bound anti-M2 mabs were visualized on viable cells with Alexafluor 647-conjugated goat anti-Human IgG H&L antibody (Invitrogen). Flow cytometry was performed with a FACSCanto, and analysis on the accompanying FACSDiva software (Becton Dickenson).

ELISA
Purified Influenza A (A/Puerto Rico/8/34) inactivated by β-propiolactone (Advanced Biotechnologies, Inc.) was biotinylated (EZ-Link Sulfo-NHS-LC-Biotin, Pierce) and adsorbed for 16 hours at 4° C. to 384-well plates in 25 μl PBS that were pre-coated with neutravidin (Pierce). Plates were blocked with BSA in PBS, samples of supernatant from transient transfections from each of the IgG heavy and light chain combinations were added at a final dilution of 1:5, followed by HRP-conjugated goat anti-human Fc antibody (Pierce), and developed with TMB substrate (ThermoFisher).

The results of this analysis are shown below in Table 2.

TABLE 2

| Transfection. | | Sequence ID | | FACS M2-HK | Virus ELISA |
|---|---|---|---|---|---|
| no | BCC well ID | Gamma | Light | MFI | OD A450 |
| 322 | 3241_G23 | G4_005 | K1_004 | 1697 | 3.02 |
| 352 | 3244_I10 | G4_007 | K2_006 | 434 | 3.01 |
| 339 | 3243_J07 | G4_007 | K1_007 | 131 | 2.94 |

TABLE 2-continued

| Transfection. | | Sequence ID | | FACS M2-HK | Virus ELISA |
|---|---|---|---|---|---|
| no | BCC well ID | Gamma | Light | MFI | OD A450 |
| 336 | 3259_J21 | G4_005 | K2_005 | 1673 | 2.40 |
| 348 | 3245_O19 | G3_004 | K1_001 | 919 | 3.51 |
| 345 | 3244_H04 | G3_003 | K1_006 | 963 | 3.31 |
| 346 | | Pos Cont (HC) | Pos Cont (LC) | 754 | 2.69 |
| 347 | | Neg Cont (HC) | Neg Cont (LC) | 11 | 0.15 |
| 374 | 3136_G05 | G4_007 | K1_007 | 109 | ND |
| 386 | 3252_C13 | G4_013 | K1_002 | 449 | ND |
| 390 | 3255_J06 | G4_013 | K2_007 | 442 | ND |
| 400 | 3420_I23 | G4_004 | K1_003 | 112 | ND |
| 432 | 3139_P23 | G4_016 | K1_007a | 110 | 1.02 |
| 412 | 3248_P18 | G4_009 | K1_006 | 967 | 0.56 |
| 413 | 3253_P10 | G4_007 | K1_004 | 43 | 0.50 |
| 434 | 3260_D19 | G3_004a | K2_001 | 846 | 2.46 |
| 439 | 3362_B11 | G4_010a | K1_007 | 218 | 1.83 |
| 408 | 3242_P05 | G3_005 | K2_004 | 596 | 0.50 |
| 451 | | Pos Cont (HC) | Pos Cont (LC) | 1083 | 1.87 |
| 452 | | Neg Cont (HC) | Neg Cont (LC) | 6 | 0.05 |

Positive control: supernatant from transient transfection with the IgG heavy and light chain combination of mAb 8I10
Negative control: supernatant from transient transfection with the IgG heavy and light chain combination of mAb 2N9
MFI = mean fluorescence intensity Example 12

Human Antibodies Reveal a Protective Epitope that is Highly Conserved among Human and Non-Human Influenza A Viruses Influenza remains a serious public health threat throughout the world. Vaccines and antivirals are available that can provide protection from infection. However, new viral strains emerge continuously because of the plasticity of the influenza genome which necessitates annual reformulation of vaccine antigens, and resistance to antivirals can appear rapidly and become entrenched in circulating virus populations. In addition, the spread of new pandemic strains is difficult to contain due to the time required to engineer and manufacture effective vaccines. Monoclonal antibodies that target highly conserved viral epitopes might offer an alternative protection paradigm. Herein we describe the isolation of a panel of monoclonal antibodies derived from the IgG⁺ memory B cells of healthy, human subjects that recognize a previously unknown conformational epitope within the ectodomain of the influenza matrix 2 protein, M2e. This antibody binding region is highly conserved in influenza A viruses, being present in nearly all strains detected to date including highly pathogenic viruses that infect primarily birds and swine, and the current 2009 swine-origin H1N1 pandemic strain (S-OIV). Furthermore, these human anti-M2e monoclonal antibodies protect mice from lethal challenges with either H5N1 or H1N1 influenza viruses. These results suggest that viral M2e can elicit broadly cross-reactive and protective antibodies in humans. Accordingly, recombinant forms of these human antibodies may provide useful therapeutic agents to protect against infection from a broad spectrum of influenza A strains.

Introduction
Seasonal influenza epidemics hospitalize more than 200,000 people each year in the US and kill an estimated 500,000 worldwide (Thompson, W. W. et al. (2004) JAMA 292:1333-1340). The immune system affords only partial protection from seasonal strains in most individuals because of constantly arising point mutations in the viral genome which lead to structural variability known as antigenic drift. Pandemic strains encounter even less immune resistance due to genomic reassortment events among different viruses which result in more radical shifts in viral antigenic determinants. Consequently, pandemic influenza has the potential to cause widespread illness, death, and economic disruption. Vaccines and antiviral agents are available to counter the threat of influenza epidemics and pandemics. However, the strain composition of influenza vaccines must be determined prior to the influenza season on an annual basis, and predicting in advance which strains will become dominant is challenging. Moreover, the emergence of strains that evade vaccine-induced, protective immune responses is relatively rapid which often results in inadequate protection (Carrat F, Flahault A. (2007) Influenza vaccine: the challenge of antigenic drift. Vaccine 25:6852-6862). Antiviral drugs include oseltamivir and zanamivir which inhibit the function of the viral protein neuraminidase (NA), and adamantanes which inhibit the ion channel function of the viral M2 protein (Gubareva L V, et al. (2000) Lancet 355:827-835; Wang C, et al. (1993) J Virol 67:5585-5594). Antiviral agents are effective for sensitive virus strains but viral resistance can develop quickly and has the potential to render these drugs ineffective. In the 2008-2009 US influenza season nearly 100% of seasonal H1N1 or H3N2 influenza isolates tested were resistant to oseltamivir or adamantane antivirals, respectively (CDC Influenza Survey: www.cdc.gov/flu/weekly/weeklyarchives2008-2009/weekly23.htm).

Passive immunotherapy using anti-influenza antibodies represents an alternative paradigm for preventing or treating viral infection. Evidence for the utility of this approach dates back nearly 100 years when passive serum transfer was used during the 1918 influenza pandemic with some success (Luke T C, et al. (2006) Ann Intern Med 145:599-609). While protection provided by anti-influenza monoclonal antibodies (mAbs) is typically narrow in breadth because of the antigenic heterogeneity of influenza viruses, several groups have recently reported protective mAbs that bind to conserved epitopes within the stem region of viral hemagglutinin (HA) (Okuno Y, et al. (1993) J Virol 67:2552-2558; Throsby M, et al. (2008) PLoS One. 3: e3942; Sui J, et al. (2009) Nat Struct Mol Biol 16:265-273; Corti D, et al. (2010) J Clin Invest doi:10.1172/JCI41902). These epitopes appear to be restricted to a subset of influenza viruses; these anti-HA mAbs would not be expected to provide protection against viruses of the H3 and H7 subtypes. Of these, the former comprises an important component of circulating human strains (Russell C A, et al. (2008) Science 320:340-346) while the latter includes highly pathogenic avian strains which have caused mortality in humans (Fouchier R A, et al. (2004) Proc Natl Acad Sci USA 101:1356-1361; Belser J A, et al. (2009) Emerg Infect Dis 15:859-865).

Of the three antibody targets present on the surface of the influenza virus, the ectodomain of the viral M2 protein (M2e) is much more highly conserved than either HA or NA, which makes, it an attractive target for broadly protective mAbs. Monoclonal antibodies to M2e have been shown to be protective in vivo (Wang R, et al. (2008) Antiviral Res 80:168-177; Liu W, et al. (2004) Immunol Lett 93:131-6; Fu T M, et al. (2008) Virology 385:218-226; Treanor J J, et al. (1990) J Virol 64:1375-1357; Beerli R, et al. (2009) Virology J 6:224-234), and several groups have demonstrated protection against infection with vaccine strategies based on M2e (Fu T M, et al. (2009) Vaccine 27:1440-1447; Fan J, et al. (2004) Vaccine 22:2993-3003; Slepushkin V A, et al. (1995) Vaccine 13:1399-1402; Neirynck S, et al. (1999) Nat Med 5:1157-1163; Tompkins S M, et al. (2007) Emerg Infect Dis 13:426-435; Mozdzanowska K, et al. (2003) Vaccine 21:2616-2626). In these cases, purified M2 protein or peptides derived from M2e sequence have been used as immunogens to generate anti-M2e antibodies in animals or as vaccine candidates. In the present study, mAbs were isolated directly from human B cells that bind to the M2 protein displayed on virus particles and on virus-infected cells. Further, we demonstrate that these antibodies protect mice from a lethal influenza A virus challenge and that they can recognize M2 variants derived from a wide range of human and animal influenza A virus isolates. This combination of properties may enhance the utility of these antibodies to prevent and treat influenza A virus infections.

Results and Discussion

Isolation of a Family of Anti-M2e mAbs from Human B Cells. To explore the humoral immune response to natural influenza infection in humans, we have isolated antibodies from IgG+ memory B cells of M2e-seropositive subjects. Serum samples from 140 healthy adult, United States-sourced donors were tested for reactivity with M2e expressed on the surface of HEK293 cells that were transfected with a viral M2 gene (derived from A/Fort Worth/50 H1N1). IgG+ memory B cells from 5 of the 23 M2e-seropositive subjects were cultured under conditions where they proliferated and differentiated into IgG-secreting plasma cells. B cell culture wells were screened for IgG reactivity to cell-surface M2e and immunoglobulin heavy and light chain variable region ($V_H$ and $V_L$) genes were rescued by RT-PCR from 17 positive wells and incorporated into a human IgG1 constant region background for recombinant expression and purification. VH and VL sequences of 15 of the 17 anti-M2e mAbs cluster into two related groups (Table 3) (IMGT®, the International ImMunoGeneTics Information system®, available at www.imgt.org). In group A, assignment of the germline VH gene segment is IGHV4-59*01 while in the group B, the germline gene segment is IGHV3-66*01. The two more distantly related mAbs 62B11 and 41G23 (group C) utilize the germline V gene segment IGHV4-31*03 which has only 5 amino acid residue differences from the germline V gene segment IGHV4-59*01 of group A. All of these mAbs utilize the same light chain V gene, IGKV1-39*01 or its allele IGKV1D-39*01 and show evidence of somatic hypermutation from the germline heavy or kappa chain sequence (FIG. 12). Competitive binding experiments showed that all of these human mAbs appear to bind similar sites on native M2e expressed on the surface of Chinese hamster ovary (CHO) cells (FIG. 13). We selected for further characterization one mAb from each of groups A and B, designated TCN-031 and TCN-032, respectively.

TABLE 3

Immunoglobulin gene segment usage of human anti-M2e antibodies.

| | mAb | Heavy chain germline gene segments | | | Light chain germline gene segments | |
|---|---|---|---|---|---|---|
| | | Variable | Diversity | Joining | Variable | Joining |
| Group A | TCN-032 | IGHV4-59*01 | IGHD2-15*01 | IGHJ4*02 | IGKV1-39*01, or IGKV1D-39*01 | IGKJ4*01 |
| | 43J7 | IGHV4-59*07 | IGHD1-26*01 | IGHJ4*02 | IGKV1-39*01, or IGKV1D-39*01 | IGKJ2*01 |
| | 53P10 | IGHV4-59*07 | IGHD1-26*01 | IGHJ4*02 | IGKV1-39*01, or IGKV1D-39*01 | IGKJ2*01 |
| | 44I10 | IGHV4-59*07 | IGHD1-26*01 | IGHJ4*02 | IGKV1-39*01, or IGKV1D-39*01 | IGKJ2*01 |
| | 55J6 | IGHV4-59*01 | IGHD5-18*01 | IGHJ4*02 | IGKV1-39*01, or IGKV1D-39*01 | IGKJ5*01 |
| | 52C13 | IGHV4-59*01 | IGHD5-18*01 | IGHJ4*02 | IGKV1-39*01, or IGKV1D-39*01 | IGKJ5*01 |
| | 39P23 | IGHV4-59*01 | IGHD4-23*01 | IGHJ4*01 | IGKV1-39*01, or IGKV1D-39*01 | IGKJ1*01 |
| | 36G5 | IGHV4-59*01 | IGHD2-8*01 | IGHJ6*04 | IGKV1-39*01, or IGKV1D-39*01 | IGKJ3*01 |
| | 48P18 | IGHV4-59*01 | IGHD2-15*01 | IGHJ6*02 | IGKV1-39*01, or IGKV1D-39*01 | IGKJ4*01 |
| | 59J21 | IGHV4-59*01 | IGHD2-15*01 | IGHJ6*02 | IGKV1-39*01, or IGKV1D-39*01 | IGKJ4*01 |
| | 20I23 | IGHV4-59*01 | IGHD6-6*01 | IGHJ6*02 | IGKV1-39*01, or IGKV1D-39*01 | IGKJ5*01 |
| Group C | 62B11 | IGHV4-31*03 | IGHD4-23*01 | IGHJ6*02 (a) | IGKV1-39*01, or IGKV1D-39*01 | IGKJ5*01 |
| | 41G23 | IGHV4-31*03 | IGHD3-16*01 | IGHJ6*02 | IGKV1-39*01, or IGKV1D-39*01 | IGKJ5*01 |
| Group B | TCN-031 | IGHV3-66*01 | IGHD3-10*01 | IGHJ3*01 | IGKV1-39*01, or IGKV1D-39*01 | IGKJ2*01 |
| | 44H4 | IGHV3-66*01 | Cannot assign | IGHJ6*02 | IGKV1-39*01, or IGKV1D-39*01 | IGKJ5*01 |
| | 45O19 | IGHV3-66*01 | Cannot assign | IGHJ6*02 | IGKV1-39*01, or IGKV1D-39*01 | IGKJ5*01 |
| | 60D19 | IGHV3-66*01 | Cannot assign | IGHJ6*02 | IGKV1-39*01, or IGKV1D-39*01 | IGKJ2*01 |

Reference sequences for each mAb heavy and light chain were analysed using IMGT/V-QUEST to determine gene usage.

High Affinity Binding to the Surface of Influenza Virus. Both TCN-031 and TCN-032 bound directly to an H1N1 virus (A/Puerto Rico/8/34) with high avidity, with half-maximal binding at about 100 ng/mL (FIG. 14a). Fab fragments prepared from TCN-031 and TCN-032 bound virus with affinities (KD) of 14 and 3 nM, respectively, as determined by surface plasmon resonance (Table 4). The human mAbs did not bind appreciably to a 23 amino acid synthetic peptide corresponding to the M2e domain of an H1N1 virus (A/Fort Worth/1/50) (FIG. 14b). A chimeric derivative of the murine anti-M2e mAb 14C2 (ch14C2), which was originally generated by immunization with purified M2 (Zebedee S L and Lamb R A. (1988) J Virol 62:2762-2772), exhibited the opposite behavior to that observed with the human mAbs, with little binding to virus but robust binding to the isolated 23mer M2e peptide with half-maximal binding to peptide at 10 ng/mL (FIGS. 14a and 14b). Interestingly, both the human mAbs and ch14C2 bound to the surface of Madin-Darby canine kidney (MDCK) cells infected with H1N1 virus (A/Puerto Rico/8/34) with similar avidities (FIG. 14c). It thus appears that viral epitopes recognized by the human anti-M2e mAbs are present and accessible on the surface of both virus and infected cells, while the epitope bound by ch14C2 is accessible only on the surface of infected cells. Our observation that the human anti-M2e mAbs do not bind appreciably to immobilized synthetic peptides derived from M2e, and further that such peptides do not compete for binding of these antibodies to M2e expressed on the surface of mammalian cells (FIG. 14d), supports the idea that secondary structure within the M2e epitope is important for binding by the human antibodies. That ch14C2 binds peptide immobilized on plastic suggests a lesser importance of higher order structure for binding of this mAb.

TABLE 4

Affinity of anti-M2e Fab fragments for influenza virus.

| Fab | ka ($M^{-1} * s^{-1}$) | kd ($s^{-1}$) | KD |
|---|---|---|---|
| TCN-031 | 1.0e6 | 1.4e-2 | 14 nM |
| TCN-032 | 7.4e5 | 2.3e-3 | 3.2 nM |
| cH14C2 | 5.0e2 | 1.8e-3 | 4.0 µM |

Figure 15A:
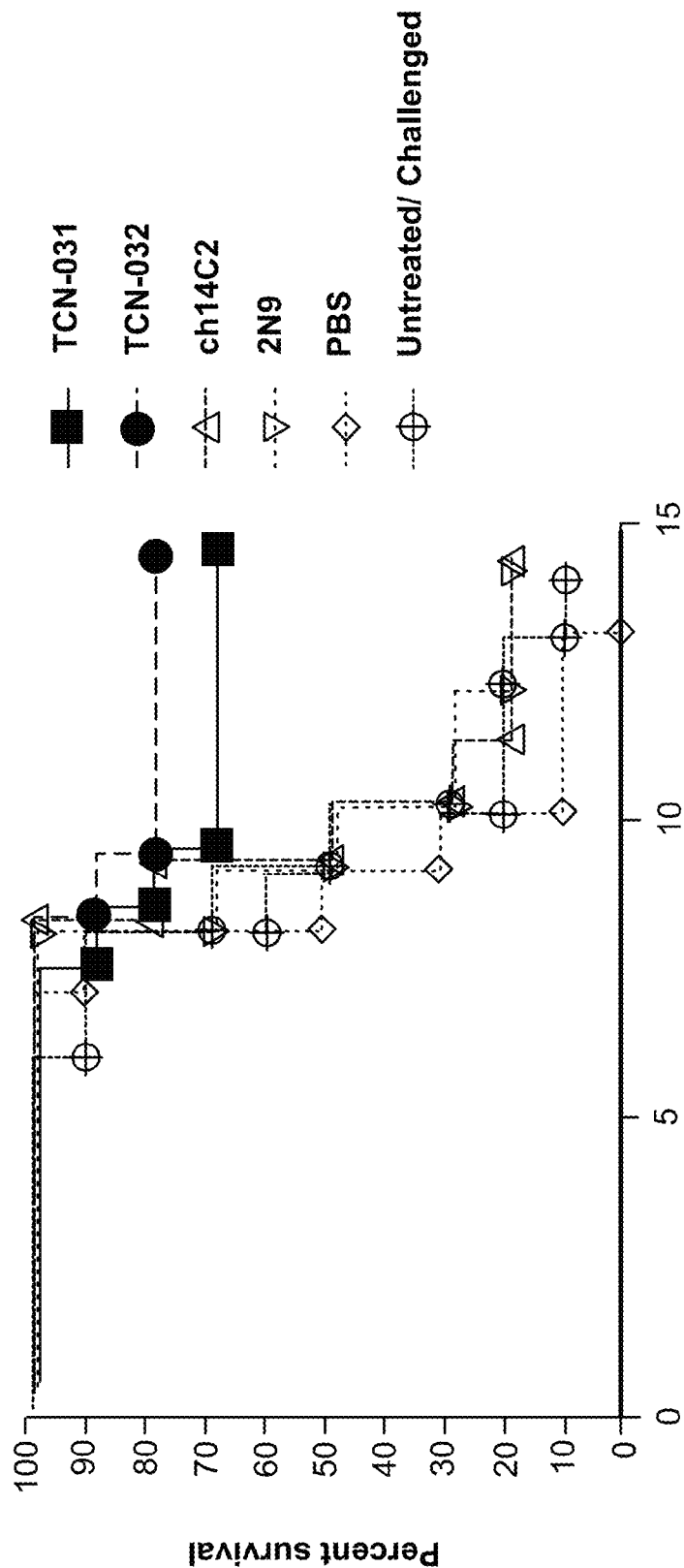
Figure 15B:
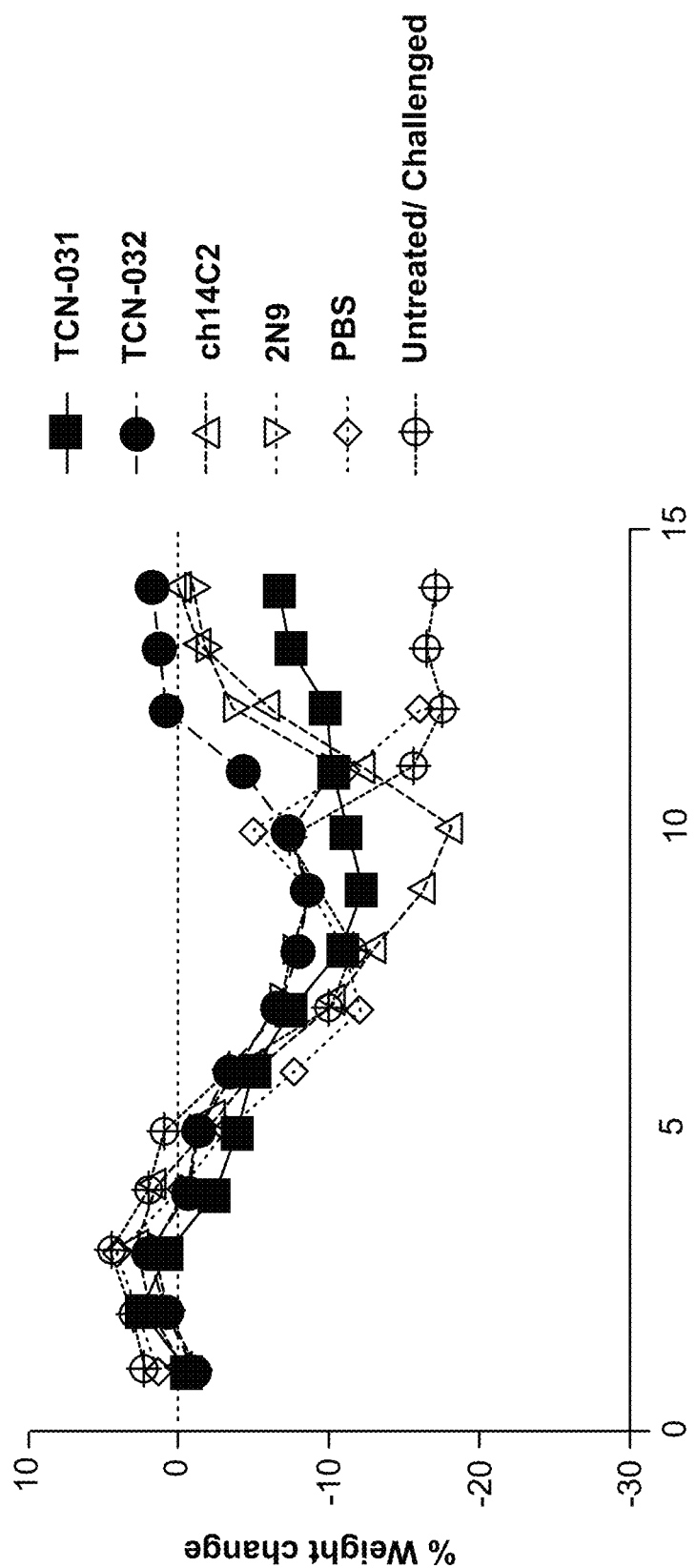

Protection from Lethal Challenges with H5N1 and H1N1 viruses. We next examined the protective efficacy of the human anti-M2e mAbs TCN-031 and TCN-032 in a lethal challenge model of influenza infection in mice. Animals were challenged intranasally with 5×LD50 units of a high-pathogenicity H5N1 virus (A/Vietnam/1203/04) and both human mAbs were protective when treatment was initiated one day after viral challenge. In contrast, mice that were subjected to similar treatment regimens with a subclass-matched, irrelevant control mAb 2N9, which targets the AD2 epitope of the gp116 portion of the human cytomegalovirus gB, or with a vehicle control were protected to a lesser extent, or not at all, resulting in 70-80% survival for mice treated with human mAbs versus 20% survival for control mAb and 0% survival for vehicle (FIG. 15a). The anti-M2e mAb ch14C2 did not confer substantial protection in this model (20% survival; FIG. 15a), though this mAb has been shown to reduce the titer of virus in the lungs of mice infected with other strains of influenza virus (Treanor J J, et al. (1990) J Virol 64:1375-1357). All of the animals, including those in the TCN-031 and TCN-032 treatment groups, exhibited weight loss from days 4 to 8 post infection followed by a gradual increase in weight in the surviving animals through the end of the study on day 14 (FIG. 15b), indicating that the human anti-M2e mAbs afforded protection by reducing the severity or extent of infection rather than by completely preventing infection. Indeed, results of immunohistological and viral load analyses of lung, brain and liver tissue from additional animals in each treatment cohort are consistent with a reduction in the spread of virus beyond the lung to the brain and also possibly liver in animals that were treated with the human anti-M2e mAbs, but not with ch14C2 or the subclass-matched control mAb 2N9. The effect of the human anti-M2e mAbs on viral load in the lung versus the control mAbs was, however, more moderate (Table 5 and FIG. 16, respectively).

Figure 15C:
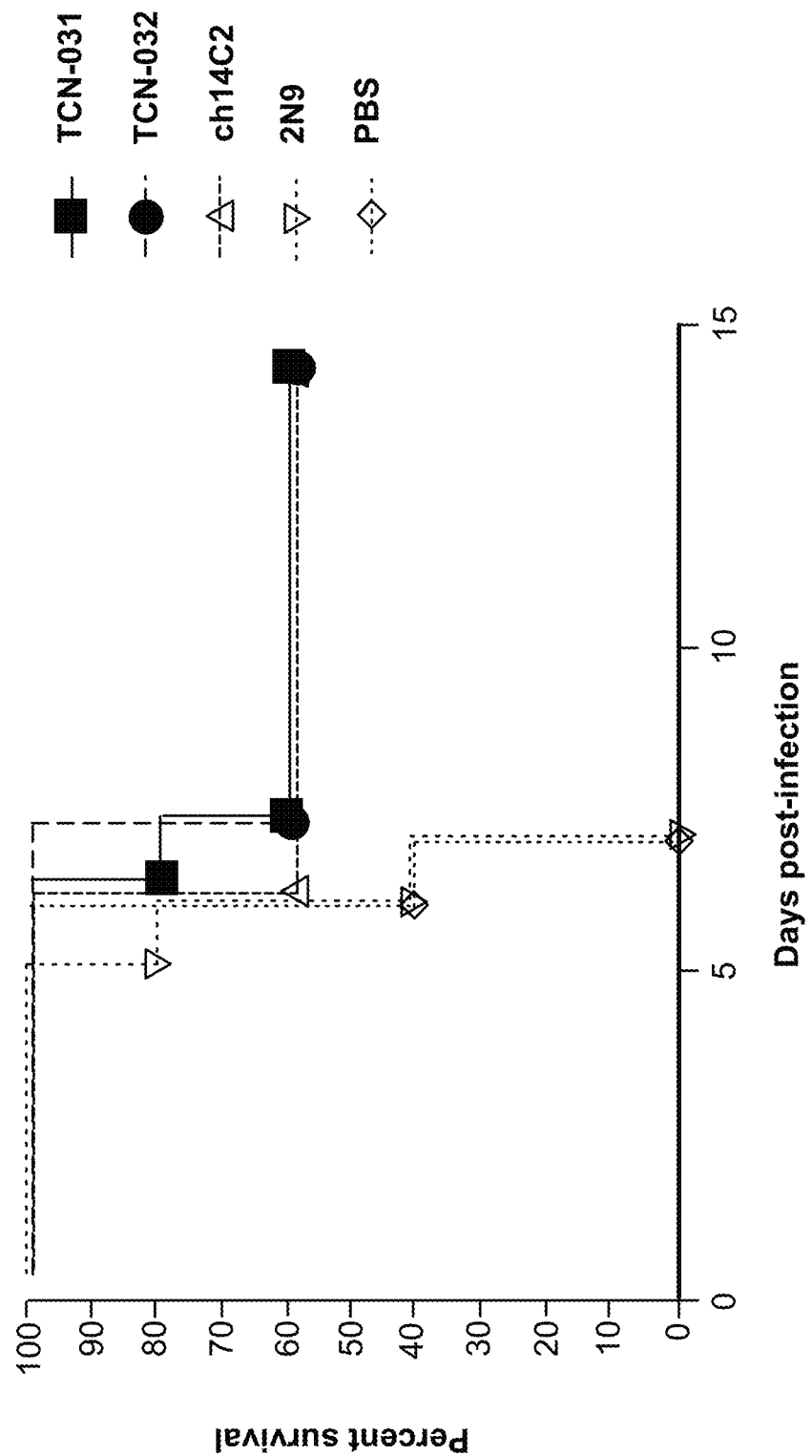
Figure 15D:
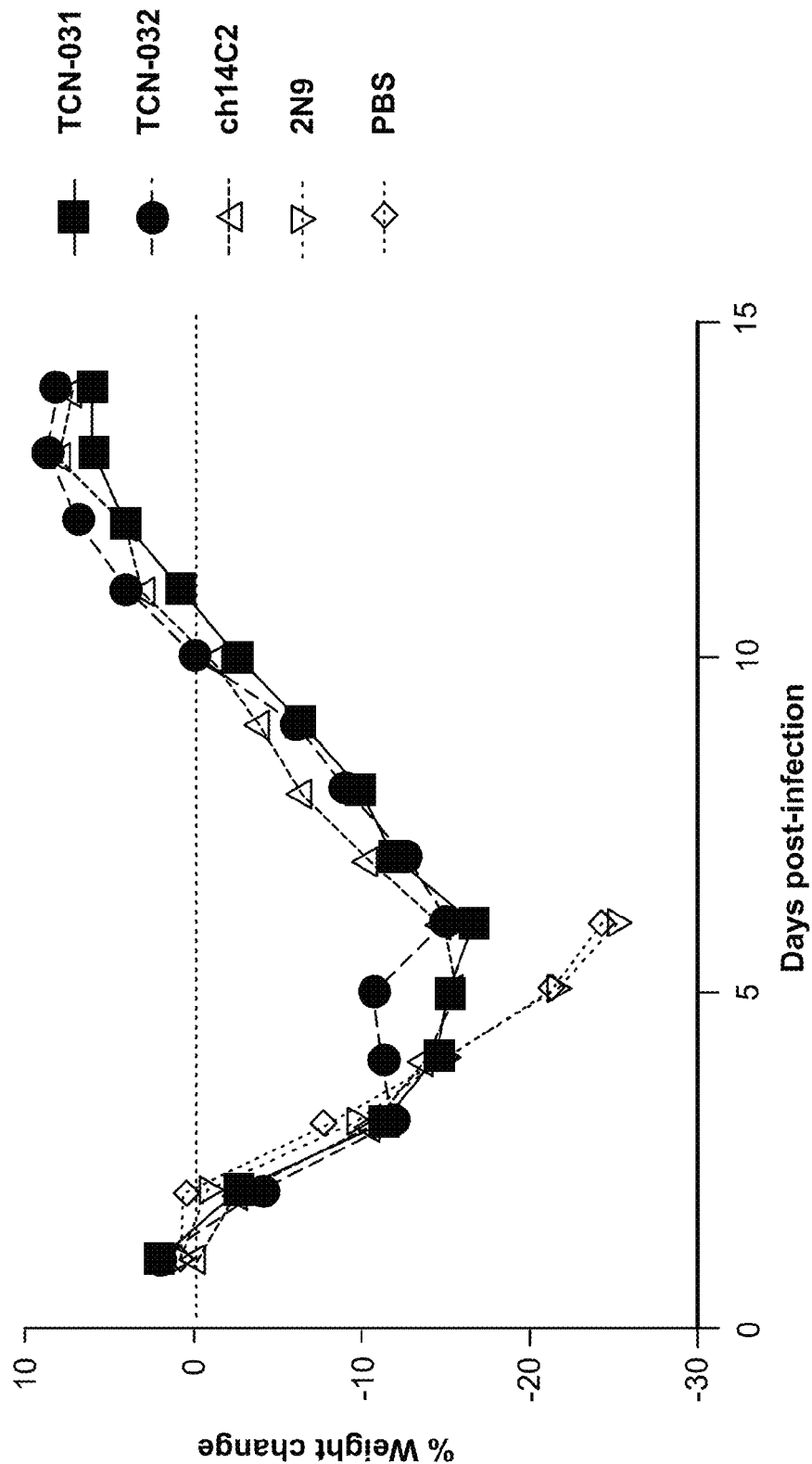

To test whether protection conferred by the human anti-M2e mAbs mirrors their broad binding behavior, we performed a similar in vivo challenge study with a mouse-adapted isolate of the relatively divergent H1N1 virus A/Puerto Rico/8/34. One hundred percent of PBS-treated or subclass-matched, control antibody-treated mice were killed by this virus, while a majority of the animals treated with the human anti-M2e mAbs TCN-031 and TCN-032 survived (60%; FIG. 15c). With this virus mice treated with ch14C2 provided a similar survival benefit to that of the human anti-M2e mAbs (FIG. 15c). Weight changes in each treatment group throughout the course of infection and its subsequent resolution followed a pattern that was similar to that of mice infected with the H5N1 virus (FIG. 15d).

The human anti-M2e mAbs and ch14C2 bound to cell surface-expressed M2e from A/Vietnam/1203/04 and A/Puerto Rico/8/34 viruses (FIG. 19b, Table 6) and cells infected with A/Puerto Rico/8/34 (FIG. 14c). Mechanisms for antibody-mediated protection could include killing of infected host cells by antibody-dependent cell-mediated cytotoxicity or complement-dependent cytotoxicity (Wang R, et al. (2008) Antiviral Res 80:168-177; Jegerlehner A, et al. (2004) J Immunol 172:5598-5605). We found in vitro evidence for both of these mechanisms with the human anti-M2e mAbs and ch14C2 (FIG. 17 and Table 6). An explanation for the enhanced in vivo protection observed with the human anti-M2e mAbs as compared to ch14C2 following challenge by the high-pathogenicity avian virus A/Vietnam/1203/04 as compared with A/Puerto Rico/8/34 could be due to the unique capability of the human mAbs to bind virus directly whereas ch14C2 does not appear to bind influenza virions (FIG. 14a). Protective properties of antibodies that bind to virus might be expected to include mechanisms such as antibody-dependent virolysis (Nakamura M, et al. (2000) Hybridoma 19:427-434) and clearance via opsonophagocytosis by host cells (Huber V C, et al. (2001) J Immunol 166:7381-7388). Some of these mechanisms require efficient interaction between antibodies and host Fc receptors. In our mouse challenge experiments all of the mAbs tested had human constant regions; however other studies have shown that human antibodies can interact productively with murine Fc receptors (Clynes R A, et al. (2000) Nat Med 6:443-446).

TABLE 5

Pathological assessment of lung, liver, and brain of mice treated with anti-M2e mAbs TCN-031 and TCN-032 after challenge with H5N1 A/Vietnam/1203/04.

| Organs | Mouse | TCN-031 | TCN-032 | 2N9 | CH14C2 | PBS | UT/C |
|---|---|---|---|---|---|---|---|
| Lung | 1 | ++/++ | ++/++ | ++/++ | ++/++ | ++/++ | ++/+++ |
| | 2 | ++/++ | ++/++ | ++/+++ | ++/++ | ++/++ | ++/++ |
| | 3 | ++/++ | ++/++ | ++/++ | ++/++ | ++/+++ | ++/++ |
| Brain | 1 | −/− | −/− | +/+ | −/− | +/+++ | ++/+++ |
| | 2 | −/− | ±/+ | +/+++ | +/+ | −/− | +/+ |
| | 3 | −/− | −/− | +/+ | +/++ | +/+++ | ++/+++ |
| Liver | 1 | −/− | −/− | +/+ | +/− | +/+ | +/+ |
| | 2 | −/− | −/− | +/+ | +/− | +/− | +/− |
| | 3 | −/− | +/− | +/+ | +/+ | +/+ | +/+ |

Pathological changes and viral antigens were detected in the lungs of all virus-challenged mice. The mice had similar lung lesions across all groups, although mice in the TCN-031 and TCN-032 groups had a tendency toward less viral antigen expression in the lung. In the brain and liver, lesions were not detected in mice in the TCN-31 group and only one of three mice in the TCN-032 group showed some evidence of viral antigens in the brain.

Pathological changes/viral antigens:

+++ severe/many,

++ moderate/moderate,

+ mild/few,

± scant/rare,

− not observed/negative.

TABLE 6

Amino acids 1-23 of the M2 extracellular domain

| | | S | L | L | T | E | V | E | T | P | T | R | N | E | W | G | C | R | C | N | D | S | S | D |
|---|---|---|---|---|---|---|---|---|---|---|---|---|---|---|---|---|---|---|---|---|---|---|---|---|
| 1 | A/Brevig Mission/1/1918 H1N1 | | | | | | | | | | | | | | | | | | | | | | | |
| 2 | A/Fort Monmouth/1/1947 H1N1 | | | | | | | | | | K | | | | | E | | | | | | | | |
| 3 | A/Singapore/02/2005 H3N2 | | | | | | | | | I | | | | | | E | | | | | | | | |
| 4 | A/Wisconsin/10/1998 H1N1 | | | | | | | | | I | | | | | | G | E | | | | | | | |
| 5 | A/Wisconsin/301/1976.H1N1 | | | | | | | | | I | | S | | | | | | | | | | | | |
| 6 | A/Panama/1/1966 H2N2 | | F | | P | | | | | I | | | | | | | | | | | | | | |
| 7 | A/New York/321/1999 H3N2 | | | | | | | | | I | | | | | | | | | | | | | | N |
| 8 | A/Caracai/1/1971 H3N2 | | | | | | | | | I | | K | | | | | | | | | | | | |
| 9 | A/Taiwan/3/1971 H3N2 | | F | | | | | | | I | | S | | | | | | | | | | | | |
| 10 | A/Wuhan/359/1995 H3N2 | | | P | | | | | | I | | S | | | | | | | | | | | | |
| 11 | A/Hong Kong/1144/1999 H3N2 | | | | | | | | | I | | | | | | | | | | | | | | |
| 12 | A/Hong Kong/1180/1999 H3N2 | | | | P | | | | | I | | | G | | | | | | | | | | | |
| 13 | A/Hong Kong/1774/1999 H3N2 | | | | | | | | | | | | G | E | | | | | S | G | | | | |
| 14 | A/New York/217/2002 H1N1 | | | | | | | | | I | | | | E | Y | | | | | | | | | |
| 15 | A/New York/300/2003 H1N1 | | | | | | | | | I | | | | E | Y | | | S | | | | | | |
| 16 | A/swine/Spain/54008/2004 H3N2 | | | | | | | | | | | | G | E | | | Y | S | | | | | | |
| 17 | A/Guangzhou/333/99 H9N2 | | F | | | | | L | | | | | G | E | | | | S | | | | | | |
| 18 | A/Hong Kong/1073/1999 H9N2 | | | | | | | L | | | | | G | E | | K | | R | | | | | | |
| 19 | A/Hong Kong/1/1968 H3N2 | | | | | | | | | I | | | | | | | | | | | | | | |
| 20 | A/swine/Hong Kong/126/1982 H3N2 | | | | | | | | | I | | S | | | | | | | | | G | | | |
| 21 | A/New York/703/1995 H3N2 | | | | | | | | | I | | | | E | | | | | G | | | | | |
| 22 | A/Swine/Quebec/192/1981 H1N1 | | | | P | | | | | I | | | | | | | | | | | | | | |

TABLE 6-continued

| # | Strain | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 |
|---|---|---|---|---|---|---|---|---|---|---|---|---|---|---|---|---|---|---|---|---|---|---|---|---|
| 23 | A/Puerto Rico/8/1934 H1N1 | | | | | | | | | | I | | | | | | | | | | G | | | |
| 24 | A/Hong Kong/485/1997 H5N1 | | | | | | | | D | L | | | | G | | | | | | S | | | | |
| 25 | A/Hong Kong.542/1997 H5N1 | | | | | | | | | L | K | | | G | | | | | | S | | | | |
| 26 | A/silky chicken/Shantou/1826/2004 H9N2 | | | | | | | | | | | | | G | E | K | | | | S | | | | |
| 27 | A/chicken/Taiwan/0305/2004 H6N1 | | | | | | | | | H | | | | G | E | K | | | | S | | | | |
| 28 | A/Quail/Arkanasas/16309-7/1994 H7N3 | | | | | K | | | | | | | | G | E | K | | | | S | | | | |
| 29 | A/Hong Kong/486/1997 H5N1 | | | | | | | | | L | | | | G | | | | | | S | | | | |
| 30 | A/chicken/Pennsylvania/13552-1/1998 H7N2 | | | | | | | | | | | | D | G | E | K | | | | S | | | | |
| 31 | A/chicken/Heilongjiang/48/2001 H9N2 | | | | | | | | | | | | | G | | | | | | S | | | | |
| 32 | A/swine/Korea/S5/2005 H1N2 | | | | | | | | | | | | | G | E | K | | | | | | | | |
| 33 | A/Hong Kong/1073/1999 H9N2 | | | | | | | | | L | | | | G | E | K | | | | S | | | | |
| 34 | A/Wisconsin/3523/1988 H1N1 | | | | | | | | | | I | | | | | K | | | | | | | | |
| 35 | A/X-31 Vaccine strain H3N2 | F | | | | | | | | | I | | | | | | | | | | G | | | |
| 36 | A/Chicken/Rostock/8/1934 H7N1 | | | | | | | | | | | | | G | E | | | | | | | | | |
| 37 | A/environment/New York/16326-1/2005 H7N2 | | | | | | | | | | I | K | | G | E | | | | | N | S | | | |
| 38 | A/chicken/Hong Kong/SF1/2003 H9N2 | | | | G | | | | | H | | | | G | | K | | | | S | | | | |
| 39 | A/chicken/Hong Kong/YU427/2003 H9N2 | | | | P | | | | | H | | | | G | | | | | | S | | | | |
| 40 | A/Indonesia/560H/2006 H5N1 | | | | | | | | | | | | | | E | | | | | | | | | |
| HK | A/Hong Kong/483/1997 H5N1 | | | | | | | | | L | | | | G | | | | | | S | | | | |
| VN | A/Vietnam/1203/2004 H5N1 | | | | | | | | | | | | | | E | | | | | S | | | | |
| D20 | A/A/FW/1/1950 H1N1 | | | | | | | | | | I | | | | | | | | | | | | | |

The M2e sequence at the top is from A/Brevig Mission/1/18 (H1N1) and is used as the reference sequence for alignment of the M2 ecotodomain amino acids 1-23 of 43 wild-type variants.
Grey boxes denote amino acid identity with the reference sequence and white boxes are amino acid replacement mutations.
This list of non-identical sequences, except for HK, VN, and D20, was derived from M2 sequences used in references 11 and 27.
Sequence data are from the Influenza Virus Resource at the National Center for Biotechnology Information Binding to the Highly Conserved N-Terminal Segment of M2e. To better understand the unique viral binding property of the human anti-M2e mAbs we mapped their binding sites within the M2e domain. The lack of appreciable binding of the human mAbs to M2e-derived linear peptides precluded a synthetic peptide approach to fine structure mapping of their epitopes. Instead, binding of the mAbs to M2e alanine substitution mutants and naturally occurring M2 variants that were expressed on the surface of cDNA-transfected mammalian cells was quantified by flow cytometry. Binding experiments with a panel of M2 mutant proteins where each position in the 23 amino acid M2 ectodomain was substituted with alanine revealed that the first (S), fourth (T), and fifth (E) positions of the mature (methionine-clipped) M2 polypeptide were critical for binding of both TCN-031 and TCN-032 (FIG. 19a). In contrast, the binding of ch14C2 was selectively diminished when alanine was substituted at position 14 of mature M2 (FIG. 19a). These observations were confirmed in studies with a panel of divergent, naturally occurring M2 variants; substitution with proline at position 4 (Table 6: A/Panama/1/1966 H2N2, A/Hong Kong/1144/1999 H3N2, A/Hong Kong/1180/1999 H3N2, and A/chicken/Hong Kong/YU427/2003 H9N2) and glycine at position 5 (Table 6: A/chicken/Hong Kong/SF1/2003 H9N2) correlated with diminished binding of the human anti-M2e mAbs but not ch14C2 (FIG. 19b, Table 6). These results suggest that both TCN-031 and TCN-032 recognize a core sequence of SLLTE at positions 1-5 of the N-terminus of mature M2e. This is supported by data which show that these mAbs compete effectively with each other for binding to M2e expressed on the surface of CHO cells (FIG. 20). In contrast, our results indicate that ch14C2 binds to a site that is spatially distinct and downstream of the SLLTE core that is recognized by the human anti-M2e mAbs. Indeed, previous studies have shown that 14C2 binds a relatively broad, linear epitope with the sequence EVERTPIRNEW at positions 5-14 of processed M2e (Wang R, et al. (2008) Antiviral Res 80:168-177).

While the epitopes recognized by TCN-031 and TCN-032 are likely very similar, there were some differences between these human mAbs in their binding to several of the M2e mutants. For instance, TCN-031 appears to have a greater dependence than TCN-032 on residues 2 (L) and 3 (L) of the mature M2e sequence (FIG. 19a). The VH regions of these two human mAbs utilize different variable, diversity, and joining gene segments which may explain the minor differences in binding observed between these mAbs. Interestingly, despite the differences in their VH make-up these human mAbs utilize the same germline kappa chain V gene segments, albeit with distinct kappa chain joining segments.

Localization of the binding region of the human anti-M2e mAbs at the N-terminal region of M2e is especially significant in light of the remarkably high sequence conservation in this part of the polypeptide among influenza A viruses. The viral M gene segment that encodes M2 also encodes the internal viral protein M1 via differential splicing. However, the splice site is located downstream of the shared N-terminus of M2 and M1 resulting in two distinct mature polypeptides with an identical 8 amino acid N-terminal sequence (Lamb R A and Choppin P W (1981) Virology 112:729-737). Options for viral escape from host anti-M2e antibodies that bind this region might be limited as escape mutations in the N-terminal region would result in changes to not just M2 but also the M1 protein. Indeed, this N-terminal 8 amino acid segment of M2e shows nearly complete identity in the 1364 unique full-length M2 variants catalogued in the NCBI Influenza Database (www.ncbi.nlm.nih.gov/genomes/FLU/Database/multiple.cgi) while much lower levels of conservation are seen in M2e sequences downstream of this region (FIG. 19c). In fact, the core human anti-M2e antibody epitope SLLTE is present in ~98% of the 1364 unique full-length M2e sequences catalogued in the NCBI Influenza Database, including 97%, 98% and 98% of the human, swine and avian viruses, respectively. This contrasts to the much lower conservation within the linear binding sites of anti-M2e mAbs elicited by immunization with M2e peptides or proteins. For instance, 14C2 and Z3G1 (Wang R, et al. (2008) Antiviral Res 80:168-177) bind sequences that are conserved in less than 40% of influenza A viruses, and conservation within this region is even lower in avian and swine viruses (Table 7).

The linear M2e epitopes recognized by peptide-elicited antibodies may be more sensitive to escape mutations and natural substitutions that are present in some viral isolates. For example, P10L and P10H escape mutations to mAb 14C2 have been mapped to the central portion of M2e (Zharikova D, et al. (2005). J Virol 79:6644-6654) and those same substitutions also occur in M2e variants from some highly pathogenic H5N1 strains. We have found that the human mAbs TCN-031 and TCN-032 but not ch14C2 bind to the M2 variant from the H5N1 virus A/Hong Kong/483/97 (HK) which contains the P10L substitution (FIG. 19b, Table 6). Thus, monoclonal antibodies with specificities similar to that of 14C2 are likely to have limited utility as broad spectrum therapeutic agents.

In the examination of 5 human subjects we found 17 unique anti-M2e antibodies that bind the conserved N-terminal region of M2e, but did not observe IgG-reactivity with M2e-derived peptides that contain the linear epitopes recognized by 14C2 and other peptide-elicited antibodies. In contrast to the apparently uniform antibody response to M2e in naturally infected or vaccinated humans, mice immunized with M2e-derived peptides produced antibodies with a range of specificities within M2e, including the conserved N-terminus and also downstream regions (Fu T M, et al. (2008) Virology 385:218-226). It is tempting to speculate that the human immune system has evolved a humoral response that exclusively targets the highly conserved N-terminal segment of M2e rather than the more divergent, and thus less sustainably protective, downstream sites. Despite the lack of evidence for human antibodies that recognize this internal region of M2e, analysis of the evolution of the M gene suggests that this region of M2e is under strong positive selection in human influenza viruses (Furuse Y, et al. (2009) J Virol 29:67). One explanation for this finding is that selective pressure is being directed at this internal region by immune mechanisms other than antibodies. For instance, human T cell epitopes have been mapped to these internal M2e sites (Jameson J, et al. (1998) J Virol 72:8682-8689).

TABLE 7

Conservation of the viral binding site for human anti-M2e mAbs compared with those for mAbs derived from immunized mice, in influenza A.

| mAb | Human (n = 506) | Swine (n = 193) | Avian (n = 665) | All (n = 1364) |
|---|---|---|---|---|
| TCN-031, TCN-032 [1-SLLTE-5] | 97 | 98 | 98 | 98 |
| Z3G1 [2-LLTEVETPIR-11] (Ref. 11) | 79 | 39 | 7 | 38 |
| 14C2 [5-EVETPIRNEW-14] (Ref. 11) | 75 | 19 | 2 | 31 |

Recognition of 2009 H1N1 S-OIV. Broadly protective anti-influenza mAbs could be used in passive immunotherapy to protect or treat humans in the event of outbreaks from highly pathogenic, pandemic viral strains. A critical test of the potential for such mAbs as immunotherapeutic agents is whether they are capable of recognizing virus strains that may evolve from future viral reassortment events. As a case in point, the human anti-M2e mAbs TCN-031 and TCN-032 were tested for their ability to recognize the current H1N1 swine-origin pandemic strain (S-OIV). These mAbs were derived from human blood samples taken in 2007 or earlier, prior to the time that this strain is thought to have emerged in humans (Neumann G, et al. (2009) Nature 459:931-939). Both human mAbs bound to MDCK cells infected with A/California/4/2009 (S-OIV H1N1, pandemic) and A/Memphis/14/1996 (H1N1, seasonal) whereas ch14C2 bound only to cells infected with the seasonal virus (FIG. 21). If this broad binding behavior proves to correlate with protection, as was the case with A/Vietnam/1203/2004 and A/Puerto Rico/8/34, then these human mAbs might be useful to prevent or treat the S-OIV pandemic strain or possibly other pandemic strains that might emerge in the future.

While it is remarkable that humans have the capability to make antibodies that may confer nearly universal protection against influenza infection, the discovery of this heretofore un-described class of antibodies raises the question of why this virus is able to mount a productive infection in immunocompetent individuals at all. This apparent paradox may be explained by the nature of the protective M2e epitope and its relative immunogenicity. It has been noted by others that M2e appears to exhibit low immunogenicity in humans (Feng J, et al. (2006) Virol J 3:102; Liu W, et al. (2003) FEMS Immunol Med Microbio 35:141-146), especially when compared to the immunodominant virus glycoproteins HA and NA. Therefore, protective anti-M2e antibodies may exist in many individuals but at suboptimal titers. In support of this notion is our observation that most individuals did not display a detectable humoral response to M2e. We observed that fewer than 20% (23/140) of the individuals that we sampled in our cohort of healthy subjects had detectable serum levels of anti-M2e antibodies. The reasons for this phenomenon are not clear but a similar situation exists in HCMV where only a minority of HCMV seropositive subjects has measurable antibodies to the broadly conserved, neutralizing AD2 epitope within the gB complex of HCMV (Meyer H, et al. (1992) J Gen Virol 73:2375-2383; Ayata M, et al. (1994) J Med Virol 43:386-392; Navarro D, et al. (1997) J Med Virol 52:451-459).

An important requirement for an immunotherapeutic solution to the influenza threat will be the identification of protective epitopes that are conserved in pre-existing and emerging viruses. Using large-scale sampling of the human immune response to native influenza M2 we have identified a naturally immunogenic and protective epitope within the highly conserved N-terminal region of M2e. Human antibodies directed to this epitope, including those described in the present study, may be useful for the prevention and treatment of pandemic and seasonal influenza.

Methods

Memory B cell culture. Whole blood samples were collected from normal donors under IRB approved informed consent and peripheral blood mononuclear cells (PBMC) were purified by standard techniques. B cell cultures were set up using PBMC, B cells enriched by selection with M2-expressing cells, or IgG$^+$ memory B cells enriched from PBMC via negative depletion of nonIgG$^+$ cells with antibodies to CD3, CD 14, CD 16, IgM, IgA, and IgD on magnetic beads (Miltenyi, Auburn, Calif.) as previously described (Walker L, et al. (2009) Science 326:289-293). Briefly, to promote B cell activation, proliferation, terminal differentiation and antibody secretion, cells were seeded in 384-well microtiter plates in the presence of feeder cells and conditioned media generated from mitogen-stimulated human T cells from healthy donors. The culture supernatants were collected 8 days later and screened in a high throughput format for binding reactivity to M2 protein expressed on HEK 293 cells stably transfected with influenza virus M2 (A/Fort Worth/50 H1N1) using fluorescent imaging (FMAT system, Applied Biosystems).

Reconstitution of recombinant mAbs from B cell cultures. mRNA was isolated from lysed B-cell cultures using magnetic beads (Ambion). After reverse transcription (RT) with gene-specific primers, variable domain genes were PCR amplified using VH, V, and Vλ family-specific primers with flanking restriction sites (Walker L, et al. (2009) Science 326:289-293). PCR reactions producing an amplicon of the expected size were identified using 96-well E-gels (Invitrogen) and the variable domain amplicons were cloned into the pTT5 expression vector (National Research of Canada, Ottawa, Canada) containing human IgG1, Igκ, or Igλ constant regions. Each VH pool was combined with the corresponding Vκ, or Vλ pools from individual BCC wells and was transiently transfected in 293-6E cells to generate recombinant antibody. Conditioned media was harvested 3-5 days after transfection and assayed for antibody binding to M2 protein expressed on HEK 293 cells. Individual clones were isolated from positive pools and unique VH and VL genes were identified by sequencing. From these, monoclonal antibodies were subsequently expressed and re-assayed for binding activity.

ELISA. To detect viral antigen, either 10.2 µg/mL UV-inactivated H1N1 A/Puerto Rico/8/34 (PR8) virus (Advanced Biotechnologies, Inc.) was passively adsorbed to 384-well plates in 25 µL PBS/well for 16 hr at 4° C., or PR8 inactivated by β-propiolactone (Advanced Biotechnologies, Inc.) was biotinylated (EZ-Link Sulfo-NHS-LC-Biotin, Pierce) and likewise adsorbed to plates coated with neutravidin (Pierce). Virus-coated and biotinylated virus-coated plates were blocked with PBS containing 1% milk or BSA, respectively. Binding of mAbs at the indicated concentrations was detected with HRP-conjugated goat anti-human Fc antibody (Pierce) and visualized with TMB substrate (ThermoFisher). The M2e peptide, SLLTEVETPIRNEWGCRCNDSSD (SEQ ID NO: 680) (Genscript) was passively adsorbed at 1 µg/mL and antibody binding to the peptide was detected by the same method.

FACS analysis of virally infected cells. To detect M2e following in vitro infection, MDCK cells were treated with PR8 at multiplicity of infection (MOI) of 60:1 for 1 hr at 37° C. after which the culture media was replaced. The infected MDCK cells were further cultured for 16 hr before harvesting for cell staining with the indicated mAbs. Bound anti-M2 mAbs were visualized on viable cells with Alexafluor 647-conjugated goat anti-Human IgG H&L antibody (Invitrogen). Flow cytometry was performed on FACSCanto equipped with the FACSDiva software (Becton Dickenson). For the panel of anti-M2 mAbs, 20 µL samples of supernatant from transient transfections from each of the IgG heavy and light chain combinations was used to stain the 293 stable cell line expressing M2 of A/Hong Kong/483/97 FACS analysis was performed as above.

M2 variant analyses. Individual full length M2 cDNA mutants were synthesized with single ala mutations at each position of the ectodomain representing A/Fort Worth/1/1950 (D20), as well as were the forty-three naturally occurring variants of M2 (Blue Heron Technology). They were cloned into the plasmid vector pcDNA3.1. After transient transfection with Lipofectamine (Invitrogen), HEK293 cells were treated with 1 µg/mL of the indicated mAbs in PBS supplemented with 1% fetal bovine serum and 0.2% NaN3 (FACS buffer). Bound anti-M2 mAbs were visualized on viable cells with Alexafluor 647-conjugated goat anti-Human IgG H&L antibody (Invitrogen). Flow cytometry was performed with FACSCanto equipped with the FACSDiva software (Becton Dickenson). The relative binding to the naturally occurring variants was expressed as the percentage of the respective mAb staining of the D20 transiently transfected cells, using the formula of Normalized MFI (%) 100×(MFIexperimental-MFImock transfected)/(MFID20-MFImock transfected).

Therapeutic efficacy studies in mice. Animal studies were conducted under Institutional Animal Care and Use Committee protocols. We inoculated 6 groups of 10 mice (female 6-8 week old BALB/C) intranasally with $5\times_{LD50}$ of A/Vietnam/1203/04 (FIGS. 15a and b) or 6 groups of 5 mice intranasally with $5\times_{LD50}$ A/Puerto Rico/8/34 (FIGS. 15c and d). At 24, 72, and 120 hours post-infection the mice received intraperitoneal injections of 400 µg/200 µL dose of the anti-M2e mAbs TCN-031 TCN-032, control human mAb 2N9, control chimeric mAb ch14C2, PBS, or were left untreated. Mice were weighed daily for 2 weeks and were euthanized when weight loss exceeded 20% (H5N1 study shown in FIGS. 15a and 15b and H1N1 study shown in FIGS. 15c and 15d) of the pre-infection body weight.

Antibody reactivity to A/California/4/2009 infected cells. MDCK cells were infected with media alone or media containing A/California/4/2009 (H1N1) or A/Memphis/14/1996 (H1N1) at an MOI of approximately 1 and were cultured for 24 hours at 37° C. The cells were detached from the tissue culture plates with trypsin, washed extensively, and then fixed in 2% paraformaldehyde for 15 minutes. The cells were incubated with 1 µg/ml of the indicated antibodies and the primary antibody binding was detected with Alexafluor 647-conjugated goat anti-Human IgG H&L antibody (Invitrogen). The cells were analyzed with a Becton Dickinson FACSCalibur and data were processed using FlowJo software.

Competition analysis of antibody binding. Transient transfection supernatant containing antibody was screened for binding to 293 cells stably transfected with M2 from H1N1 (A/Fort Worth/50 H1N1), or mock transfected cells, in the presence or absence of the M2e peptide SLLTEVETPIRNEWGCRCNDSSD (Genscript) at 5 µg/mL. Bound anti-M2 mAbs were detected with anti-huIgG Fc FMAT Blue at 700 ng/ml in DMEM with 10% FCS and visualized by fluorescent imaging (FMAT system, Applied Biosystems).

Example 13

Screening and Characterization of HA-Specific Antibodies Present in Human Plasma that Bind Purified Whole Inactivated Influenza A Virions, Bind Recombinant Homotrimeric HA Proteins, and Neutralize Infectious Influenza A Fully human monoclonal antibodies specific for HA and capable of binding purified whole inactivated Influenza A Virions, binding recombinant homotrimeric HA proteins, and neutralizing live influenza A were identified in patient plasma, as described below.

Expression of Recombinant Soluble HA

An expression construct was generated containing a cDNA encoding an HA precursor (HA0) polypeptide corresponding to the derived HA sequence found in the Influenza subtypes, for example, as listed in Table 9. Recombinant HA0 precursor polypeptides of the invention lack an integral membrane or transmembrane domain, and contain additional amino acids at the C-terminus of the HA0 ectodomain, for instance, corresponding to the sequence:

```
SGRLVPRGSPGSGYIPEAPRDGQAYVRKDGEWVLLSTFLGKPIPNPLLGLDSTGHHHHHH (SEQ ID NO: 726),
``` wherein the thrombin cleavage site is bolded and italicized, the bacteriophage T4 fibritin "foldon" or trimerization domain is underlined, the last amino acid of the trimerization domain, "G", is the start of the boxed "V5" epitope tag, which is followed by the hexa histidine (HIS) epitope tag in bold. The hexa-HIS tag within the preceding C-terminal region is used for purification of recombinant HA proteins of the invention. Thus, recombinant HA0 precursor proteins that contain a trimerization domain are considered recombinant HA homotrimeric proteins of the invention.

Recombinant HA homotrimeric proteins of the invention retain the native signal sequence to allow efficient secretion from art-recognized cell lines maintained in vitro, e.g. 293 HEK cells as done by Immune Technology Corp. (http://www.immune-tech.com/). Moreover, within these recombinant HA homotrimeric proteins, or the HA0 precursors thereof, the native HA1/HA2 viral protease cleavage site was maintained, for instance, in all of the sequences provided in Table 9, except SEQ ID NO: 737, in which the native cleavage site positioned at amino acids 337-347 and consisting of the sequence "PQREGGRRRKR" (SEQ ID NO: 1250) was substituted with the sequence "PQTETR" (SEQ ID NO: 1251).

Furthermore, exemplary receptor binding domains of recombinant HA homotrimeric proteins, or the HA0 precursors thereof, include the following structural elements: a 190 α-helix, a 130-loop, and a 220-loop (see, sequence of Influenza A strain A/Vietnam/1203/2004) (or equivalent HA structures in other Influenza A strains that the ordinarily skilled artisan could readily obtain by accessing public databases, including GenBank, http://www.ncbi.nlm.nih.gov, and The Influenza Sequence Database, www.flu.lanl.gov, and downloading sequences) (Stevens et al. 2006. Science 312: 404-410). In other embodiments of the invention, in which the recombinant HA homotrimeric protein, or HA0 precursor thereof, encoded by this expression construct is partially or entirely expressed and administered to a subject, these receptor binding domains may be modified. The term "modified" is meant to describe the removal of one or more structural elements. Alternatively, or in addition, "modified" is meant to describe the addition, deletion, substitution, inversion, or translocation of one or more amino acids within a structural element of a receptor-binding domain of HA. For instance, a linear or discontinuous epitope to which a HuMHA antibody of the invention binds is administered to a subject at risk of contracting an influenza infection to prevent the infection. Alternatively or in addition, a linear or discontinuous epitope to which a HuMHA antibody of the invention binds is administered to a subject prior to exposure to an influenza virus to prevent influenza infection. In other embodiments a structural mimic of the conformational or discontinuous epitope is administered to a subject. When the above proteins are used for prophylactic purposes, for instance, as a vaccine, it may be advantageous to modify one or more receptor binding domains to control the resultant immune response in the subject. Exemplary structural elements of HA that are optionally modified include, but are not limited to, the 190 α-helix, the 130-loop, and the 220-loop of HA.

Recombinant homotrimeric HA proteins of the invention are encoded by the following amino acid sequences, wherein the native sequence is bolded and the sequence of SEQ ID NO: 726 is normal (see also, Table 9):

```
A/California/4/09
                                                     (SEQ ID NO: 727)
DTLCIGYHANNSTDTVDTVLEKNVTVTHSVNLLEDKHNGKLCKLRGVAPLHLGKC

NIAGWILGNPECESLSTASSWSYIVETPSSDNGTCYPGDFIDYEELREQLSSVSSFERF

EIFPKTSSWPNHDSNKGVTAACPHAGAKSFYKNLIWLVKKGNSYPKLSKSYINDKG

KEVLVLWGIHHPSTSADQQSLYQNADTYVFVGSSRYSKKFKPEIAIRPKVRDQEGR

MNYYWTLVEPGDKITFEATGNLVVPRYAFAMERNAGSGIIISDTPVHDCNTTCQTP

KGAINTSLPFQNIHPITIGKCPKYVKSTKLRLATGLRNIPSIQSRGLFGAIAGFIEGG

WTGMVDGWYGYHHQNEQGSGYAADLKSTQNAIDEITNKVNSVIEKMNTQFTAVG

KEFNHLEKRIENLNKKVDDGFLDIWTYNAELLVLLENERTLDYHDSNVKNLYEKV

RSQLKNNAKEIGNGCFEFYHKCDNTCMESVKNGTYDYPKYSEEAKLNREEIDGVK

LESTRIYQSGRLVPRGSPGSGYIPEAPRDGQAYVRKDGEWVLLSTFLGKPIPNPLLGLDS

TGHHHHHH

A/Solomon Islands/3/06 - H1N1
                                                     (SEQ ID NO: 728)
DTICIGYHANNSTDTVDTVLEKNVTVTHSVNLLEDSHNGKLCLLKGIAPLQLGNCS

VAGWILGNPECELLISRESWSYIVEKPNPENGTCYPGHFADYEELREQLSSVSSFER

FEIFPKESSWPNHTTTGVSASCSHNGESSFYKNLLWLTGKNGLYPNLSKSYANNKE

KEVLVLWGVHHPPNIGDQRALYHKENAYVSVVSSHYSRKFTPEIAKRPKVRDQEG
```

-continued

RINYYWTLLEPGDTIIFEANGNLIAPRYAFALSRGFGSGIINSNAPMDECDAKCQTP

QGAINSSLPFQNVHPVTIGECPKYVRSAKLRMVTGLRNIPSIQSRGLFGAIAGFIEGG

WTGMVDGWYGYHHQNEQGSGYAADQKSTQNAINGITNKVNSVIEKMNTQFTAVG

KEFNKLERRMENLNKKVDDGFIDIWTYNAELLVLLENERTLDFHDSNVKNLYEKV

KSQLKNNAKEIGNGCFEFYHKCNDECMESVKNGTYDYPKYSEESKLNREKIDGVK

LESMGVYQSGR*LVPRGS*PGSGYIPEAPRDGQAYVRKDGEWVLLSTFLGKPIPNPLLGLD

STGHHHHHH

A/South Carolina/1/18
(SEQ ID NO: 729)
MEARLLVLLCAFAATNADTICIGYHANNSTDTVDTVLEKNVTVTHSVNLLEDSHNGKL

CKLKGIAPLQLGKCNIAGWLLGNPECDLLLTASSWSYIVETSNSENGTCYPGDFIDYEE

LREQLSSVSSFEKFEIFPKTSSWPNHETTKGVTAACSYAGASSFYRNLLWLTKKGSSYP

KLSKSYVNNKGKEVLVLWGVHHPPTGTDQQSLYQNADAYVSVGSSKYNRRFTPEIAA

RPKVRDQAGRMNYYWTLLEPGDTITFEATGNLIAPWYAFALNRGSGSGIITSDAPVHD

CNTKCQTPHGAINSSLPFQNIHPVTIGECPKYVRSTKLRMATGLRNIPSIQSRGLFGAIA

GFIEGGWTGMIDGWYGYHHQNEQGSGYAADQKSTQNAIDGITNKVNSVIEKMNTQFT

AVGKEFNNLERRIENLNKKVDDGFLDIWTYNAELLVLLENERTLDFHDSNVRNLYEKV

KSQLKNNAKEIGNGCFEFYHKCDDACMESVRNGTYDYPKYSEESKLNREEIDGVKLES

MGVYQSGR*LVPRGS*PGSGYIPEAPRDGQAYVRKDGEWVLLSTFLGKPIPNPLLGLDSTGHH

HHHH

A/Japan/305/57 - H2N2
(SEQ ID NO: 730)
DQICIGYHANNSTEKVDTNLERNVTVTHAKDILEKTHNGKLCKLNGIPPLELGDCSI

AGWLLGNPECDRLLSVPEWSYIMEKENPRDGLCYPGSFNDYEELKHLLSSVKHFE

KVKILPKDRWTQHTTTGGSRACAVSGNPSFFRNMVWLTKEGSDYPVAKGSYNNTS

GEQMLIIWGVHHPIDETEQRTLYQNVGTYVSVGTSTLNKRSTPEIATRPKVNGQGG

RMEFSWTLLDMWDTINFESTGNLIAPEYGFKISKRGSSGIMKTEGTLENCETKCQT

PLGAINTTLPFHNVHPLTIGECPKYVKSEKLVLATGLRNVPQIESRGLFGAIAGFIEG

GWQGMVDGWYGYHHSNDQGSGYAADKESTQKAFDGITNKVNSVIEKMNTQFEA

VGKEFGNLERRLENLNKRMEDGFLDVWTYNAELLVLMENERTLDFHDSNVKNLY

DKVRMQLRDNVKELGNGCFEFYHKCDDECMNSVKNGTYDYPKYEEESKLNRNEI

KGVKLSSMGVYQSGR*LVPRGS*PGSGYIPEAPRDGQAYVRKDGEWVLLSTFLGKPIPNPL

LGLDSTGHHHHHH

A/Wisconsin/67/05 - H3N2
(SEQ ID NO: 731)
QKLPGNDNSTATLCLGHHAVPNGTIVKTITNDQIEVTNATELVQSSTGGICDSPHQ

ILDGENCTLIDALLGDPQCDGFQNKKWDLFVERSKAYSNCYPYDVPDYASLRSLVA

SSGTLEFNDESFNWTGVTQNGTSSSCKRRSNNSFFSRLNWLTQLKFKYPALNVTMP

NNEKFDKLYIWGVHHPVTDNDQIFLYAQASGRITVSTKRSQQTVIPNIGSRPRIRNIP

SRISIYWTIVKPGDILLINSTGNLIAPRGYFKIRSGKSSIMRSDAPIGKCNSECITPNGS

IPNDKPFQNVNRITYGACPRYVKQNTLKLATGMRNVPEKQTRGIFGAIAGFIENGW

EGMVDGWYGFRHQNSEGIGQAADLKSTQAAINQINGKLNRLIGKTNEKFHQIEKE

FSEVEGRIQDLEKYVEDTKIDLWSYNAELLVALENQHTIDLTDSEMNKLFERTKKQ

-continued

LRENAEDMGNGCFKIYHKCDNACIGSIRNGTYDHDVYRDEALNNRFQIKGVELKS

GSGR*LVPRGS*PGSGYIPEAPRDGQAYVRKDGEWVLLSTFLGKPIPNPLLGLDSTGHHHH

HH

A/swine/Ontario/01911-2/99 - H4N6

(SEQ ID NO: 732)

QNYTGNPVICLGHHAVSNGTMVKTLTDDQIEVVTAQELVESQHLPELCPSPLRLVD

GQTCDIVNGALGSPGCDHLNGAEWDVFIERPTAVDTCYPFDVPDYQSLRSILANNG

KFEFIAEEFQWNTVKQNGKSGACKRANVNDFFNRLNWLTKSDGNAYPLQNLTKV

NNGDYARLYIWGVHHPSTDTEQTNLYKNNPGRVTVSTQTSQTSVVPNIGSRPWVR

GLSSRISFYWTIVEPGDLIVFNTIGNLIAPRGHYKLNSQKKSTILNTAVPIGSCVSKCH

TDKGSISTTKPFQNISRISIGDCPKYVKQGSLKLATGMRSILEKATRGLFGAIAGFIE

NGWQGLIDGWYGFRHQNAEGTGTAADLKSTQAAIDQINGKLNRLIGKPNEKYHQI

EKEFEQVEGRIQDLEKYVEDTKIDLWSYNAELLVALENQHTIDVTDSEMNKLFERV

RHQLRENAEDKGNGCFEIFHQCDNSCIESIRNGTYDHDIYRDEAINNRFQIQGVKLI

QGYKDSGR*LVPRGS*PGSGYIPEAPRDGQAYVRKDGEWVLLSTFLGKPIPNPLLGLDSTG

HHHHHH

A/Hong Kong/156/97 - H5N1

(SEQ ID NO: 733)

MERTVLLLATVSLVKSDQICIGYHANNSTEQVDTIMEKNVTVTHAQDILERTHNGK

LCDLNGVKPLILRDCSVAGWLLGNPMCDEFINVPEWSYIVEKASPANDLCYPGNFN

DYEELKHLLSRINHFEKIQIIPKSSWSNHDASSGVSSACPYLGRSSFFRNVVWLIKKN

SAYPTIKRSYNNTNQEDLLVLWGVHHPNDAAEQTKLYQNPTTYISVGTSTLNQRLV

PEIATRPKVNGQSGRMEFFWTILKPNDAINFESNGNFIAPEYAYKIVKKGDSTIMKS

ELEYGNCNTKCQTPMGAINSSMPFHNIHPLTIGECPKYVKSNRLVLATGLRNTPQR

ERRRKKRGLFGAIAGFIEGGWQGMVDGWYGYHHSNEQGSCYSADKESTQKAIDG

VTNKVNSIINKMNTQFEAVGREFNNLERRIENLNKKMEDGFLDVWTYNAELLVLM

ENERTLDFHDSNVKNLYDKVRLQLRDNAKELGNGCFEFYHKCDNECMESVKNGT

YDYPQYSEEARLNREEISGVKLESMGTYQSGR*LVPRGS*PGSGYIPEAPRDGQAYVRKD

GEWVLLSTFLGKPIPNPLLGLDSTGHHHHHH

A/Vietnam/1203/04 - H5N1

(SEQ ID NO: 734)

DQICIGYHANNSTEQVDTIMEKNVTVTHAQDILEKKHNGKLCDLDGVKPLILRDCS

VAGWLLGNPMCDEFINVPEWSYIVEKANPVNDLCYPGDFNDYEELKHLLSRINHFE

KIQIIPKSSWSSHEASLGVSSACPYQGKSSFFRNVVWLIKKNSTYPTIKRSYNNTNQE

DLLVLWGIHHPNDAAEQTKLYQNPTTYISVGTSTLNQRLVPRIATRSKVNGQSGRM

EFFWTILKPNDAINFESNGNFIAPEYAYKIVKKGDSTIMKSELEYGNCNTKCQTPMG

AINSSMPFHNIHPLTIGECPKYVKSNRLVLATGLRNSPQRERRRKKRGLFGAIAGFI

EGGWQGMVDGWYGYHHSNEQGSGYAADKESTQKAIDGVTNKVNSIIDKMNTQFE

AVGREFNNLERRIENLNKKMEDGFLDVWTYNAELLVLMENERTLDFHDSNVKNL

YDKVRLQLRDNAKELGNGCFEFYHKCDNECMESVRNGTYDPQYSEEARLKREEI

SGVKLESIGIYQSGR*LVPRGS*PGSGYIPEAPRDGQAYVRKDGEWVLLSTFLGKPIPNPLL

GLDSTGHHHHHH

A/Indonesia/5/05 - H5N1

-continued

A/Egypt/2321-NAMRU3/07 - H5N1
(SEQ ID NO: 735)
DQICIGYHANNSTEQVDTIMEKNVTVTHAQDILEKTHNGKLCDLDGVKPLILRDCS

VAGWLLGNPMCDEFINVPEWSYIVEKANPTNDLCYPGSFNDYEELKHLLSRINHFE

KIQIIPKSSWSDHEASSGVSSACPYLGSPSFFRNVVWLIKKNSTYPTIKKSYNNTNQE

DLLVLWGIHHPNDAAEQTRLYQNPTTYISIGTSTLNQRLVPKIATRSKVNGQSGRM

EFFWTILKPNDAINFESNGNFIAPEYAYKIVKKGDSAIMKSELEYGNCNTKCQTPM

GAINSSMPFHNIHPLTIGECPKYVKSNRLVLATGLRNSPQRESRRKKRGLFGAIAGF

IEGGWQGMVDGWYGYHHSNEQGSGYAADKESTQKAIDGVTNKVNSIIDKMNTQF

EAVGREFNNLERRIENLNKKMEDGFLDVWTYNAELLVLMENERTLDFHDSNVKNL

YDKVRLQLRDNAKELGNGCFEFYHKCDNECMESIRNGTYNYPQYSEEARLKREEI

SGVKLESIGTYQSGR*LVPRGS*PGSGYIPEAPRDGQAYVRKDGEWVLLSTFLGKPIPNPLL

GLDSTGHHHHHH

A/Egypt/3300-NAMRU3/08 - H5N1
(SEQ ID NO: 736)
DQICIGYHANNSTEQVDTIMEKNVTVTHAQDILEKTHNGKLCDLDGVKPLILRDCS

VAGWLLGNPMCDEFLNVSEWSYIVEKINPANDLCYPGNFNNYEELKHLLSRINRFE

KIQIIPKSSWPDHEASLGVSSACPYQGGPSFYRNVVWLIKKNNTYPTIKKSYHNTNQ

EDLLVLWGIHHPNDEAEQTRIYKNPTTYISVGTSTLNQRLVPKIATRSKVNGQSGR

VEFFWTILKSNDTINFESNGNFIAPENAYKIVKKGDSTIMKSELEYGNCNTKCQTPI

GAINSSMPFHNIHPLTIGECPKYVKSNRLVLATGLRNSPQGERRRKKRGLFGAIAGF

IEGGWQGMVDGWYGYHHSNEQGSGYAADKESTQKAIDGVTNKVNSIIDKMNTQF

EAVGREFNNLERRIENLNKKMEDGFLDVWTYNAELLVLMENERTLDFHDSNVKNL

YDKVRLQLRDNAKELGNGCFEFYHRCDNECMESVRNGTYDPQYSEEARLKREEI

SGVKLESIGTYQSGR*LVPRGS*PGSGYIPEAPRDGQAYVRKDGEWVLLSTFLGKPIPNPLL

GLDSTGHHHHHH

A/Common magpie/Hong Kong/5052/07 - H5N1
(SEQ ID NO: 737)
DHICIGYHANNSTEQVDTIMEKNVTVTHAQDILEKTHNGKLCDLNGVKPLILKDCS

VAGWLLGNPMCDEFINVPEWSYIVEKANPANDLCYPGNFNDYEELKHLLSRINHFE

KIQIIPKDSWSDHEASLGVSSACPYQGNSSFFRNVVWLIKKGNAYPTIKKSYNNTNQ

EDLLVLWGIHHPNDEAEQTRLYQNPTTYISIGTSTLNQRLVPKIATRSKVNGQSGRI

DFFWTILKPNDAINFESNGNFIAPEYAYKIVKKGDSTIMKSEVEYGNCNTRCQTPM

GAINSSMPFHNIHPLTIGECPKYVKSNKLVLATGLRNSPQRERRRKKRGLFGAIAGFI

EGGWQGMVDGWYGYHHSNEQGSGYAADKESTQKAIDGVTNKVNSIIDKMNTQFE

AVGREFNNLERRIENLNKKMEDGFLDVWTYNAELLVLMENERTLDFHDSNVKNL

YDKVRLQLRDNAKELGNGCFEFYHKCDNECMESVRNGTYDPQYSEEARLKREEI

SGVKLESIGTYQSGR*LVPRGS*PGSGYIPEAPRDGQAYVRKDGEWVLLSTFLGKPIPNPLL

GLDSTGHHHHHH

A/Anhui/1/05 - H5N1
(SEQ ID NO: 738)
DQICIGYHANNSTEQVDTIMEKNVTVTHAQDILEKTHNGKLCDLDGVKPLILRDCS

VAGWLLGNPMCDEFINVPEWSYIVEKANPANDLCYPGNFNDYEELKHLLSRINHFE

KIQIIPKSSWSDHEASSGVSSACPYQGTPSFFRNVVWLIKKNNTYPTIKRSYNNTNQE

DLLILWGIHHSNDAAEQTKLYQNPTTYISVGTSTLNQRLVPKIATRSKVNGQSGRM

-continued

DFFWTILKPNDAINFESNGNFIAPEYAYKIVKKGDSAIVKSEVEYGNCNTKCQTPIG

AINSSMPFHNIHPLTIGECPKYVKSNKLVLATGLRNSPLRERRRKRGLFGAIAGFIE

GGWQGMVDGWYGYHHSNEQGSGYAADKESTQKAIDGVTNKVNSIIDKMNTQFEA

VGREFNNLERRIENLNKKMEDGFLDVWTYNAELLVLMENERTLDFHDSNVKNLY

DKVRLQLRDNAKELGNGCFEFYHKCDNECMESVRNGTYDYPQYSEEARLKREEIS

GVKLESIGTYQSGR*LVPRGS*PGSGYIPEAPRDGQAYVRKDGEWVLLSTFLGKPIPNPLLG

LDSTGHHHHHH

A/chicken/Vietnam/NCVD-016/08 - H5N1
(SEQ ID NO: 739)
DQICIGYHANNSTEQVDTIMEKNVTVTHAQDILEKTHNGKLCNLDGVKPLILKDCS

VAGWLLGNPMCDEFLNVSEWSYIVEKASPANGLCYPGDFNDYEELKHLLSRINHL

KKIKIIPKSYWSNHEASSGVSAACSYLGEPSFFRNVVWLIKKNNTYPPIKVNYTNTN

QEDLLVLWGIHHPNDEKEQIRIYQNPNTSISVGTSTLNQRLVPKIATRPKVNGQSGR

MEFFWTILKPNDSINFDSNGNFIAPEYAYKIAKKGDSVIMKSELEYGNCNTKCQTP

MGAINSSMPFHNIHPLTIGECPKYVKSNRLVLATGLRNAPQTETRGLFGAIAGFIEG

GWQGMVDGWYGYHHSNEQGSGYAADKESTQKAIDGITNKVNSIIDKMNTQFEIVG

REFNNLERRIENLNKKMEDGFLDVWTYNAELLVLMENERTLDFHDSNVKNLYEKV

RLQLRDNAKELGNGCFEFYHKCDNECMESVRNGTYDYPQYSEEARLSREEISGVK

MESMVTYQSGR*LVPRGS*PGSGYIPEAPRDGQAYVRKDGEWVLLSTFLGKPIPNPLLGLD

STGHHHHHH

A/northern shoveler/California/HKWF115/2007 - H6N1
(SEQ ID NO: 740)
DKICIGYHANNSTTQVDTILEKNVTVTHSVELLENQKEERFCKILNKAPLDLRGCTI

EGWILGNPQCDLLLGDQSWSYIVERPTAQNGICYPGALNEVEELKALIGSGERVER

FEMFPKSTWTGVDTSSGVTKACPYNSGSSFYRNLLWIIKTKSAAYPVIKGTYNNTGS

QPILYFWGVHHPPDTNEQNTLYGSGDRYVRMGTESMNFAKSPEIAARPAVNGQRG

RIDYYWSVLKPGETLNVESNGNLIAPWYAYKFVSTNNKGAIFKSNLPIENCDATCQ

TIAGVLRTNKTFQNVSPLWIGECPKYVKSESLRLATGLRNVPQIETRGLFGAIAGFI

EGGWTGMIDGWYGYHHENSQGSGYAADKESTQKAIDGITNKVNSIIDKMNTQFEA

VDHEFSNLERRIDNLNKRMEDGFLDVWTYNAELLVLLENERTLDLHDANVKNLYE

KVKSQLRDNANDLGNGCFEFWHKCDNECIESVKNGTYDYPKYQDESKLNRQEIES

VKLDNLGVYQSGR*LVPRGS*PGSGYIPEAPRDGQAYVRKDGEWVLLSTFLGKPIPNPLLG

LDSTGHHHHHH

A/Netherlands/219/03 - H7N7
(SEQ ID NO: 741)
DKICLGHHAVSNGTKVNTLTERGVEVVNATETVERTNVPRICSKGKRTVDLGQCG

LLGTITGPPQCDQFLEFSADLIIERREGSDVCYPGKFVNEEALRQILRESGGIDKET

MGFTYSGIRTNGTTSACRRSGSSFYAEMKWLLSNTDNAAFPQMTKSYKNTRKDPA

LIIWGIHHSGSTTEQTKLYGSGNKLITVGSSNYQQSFVPSPGARPQVNGQSGRIDFH

WLILNPNDTVTFSFNGAFIAPDRASFLRGKSMGIQSEVQVDANCEGDCYHSGGTIIS

NLPFQNINSRAVGKCPRYVKQESLLLATGMKNVPEIPKRRRRGLFGAIAGFIENGW

EGLIDGWYGFRHQNAQGEGTAADYKSTQSAIDQITGKLNRLIEKTNQQFELIDNEF

TEVERQIGNVINWTRDSMTEVWSYNAELLVAMENQHTIDLADSEMNKLYERVKR

QLRENAEEDGTGCFEIFHKCDDDCMASIRNNTYDHSKYREEAIQNRIQIDPVKLSSG

-continued

YKDSGR*LVPRGS*PGSGYIPEAPRDGQAYVRKDGEWVLLSTFLGKPIPNPLLGLDSTGHH

HHHH

H8N4 - A/duck/Yangzhou/02/2005

(SEQ ID NO: 742)

DRICIGYQSNNSTDTVNTLIEQKVPVTQTMELVETEKHPAYCNTDLGAPLELRDCKI

EAVIYGNPKCDIHLKDQGWSYIVERPSAPEGMCYPGSVENLEELRFVFSSAASYKRI

RLFDYSRWNVTSSGTSKACNASTGGQSFYRSINWLTKKKPDTYDFNEGTYVNNED

GDIIFLWGIHHPPDTKEQTTLYKNANTLSSVTTNTINRSFQPNIGPRPLVRGQQGRM

DYYWGILKRGETLKIRTNGNLIAPEFGYLLKGESHGRTIQNEDIPIGNCYTKCQTYA

GAINSSKPFQNASRHYMGECPKYVKKASLRLAVGLRNTPSVEPRGLFGAIAGFIEG

GWSGMIDGWYGFHHSNSEGTGMAADQKSTQEAIDKITNKVNNIVDKMNREFEVV

NHEFSEVEKRINMINDKIDDQIEDLWAYNAELLVLLENQKTLDEHDSNVKNLFDEV

KRRLSANAIDAGNGCFDILHKCDNECMETIKNGTYDHKEYEEEAKLERSKINGVKL

EENTTYKSGR*LVPRGS*PGSGYIPEAPRDGQAYVRKDGEWVLLSTFLGKPIPNPLLGLDST

GHHHHHH

A/Hong Kong/2108/03 - H9N2

(SEQ ID NO: 743)

DKICIGYQSTNSTETVDTLTKTNVPVTQAKELLHTEHNGMLCATNLGHPLILDTCTI

EGLIYGNPSCDLLLGGREWSYIVERPSAVNGMCYPGNVENLEELRLLFSSASSYQR

VQIFPDTIWNVTYSGTSSACSNSFYRSMRWLTQKDNTYPVQDAQYTNNRGKSILFM

WGINHPPTDTVQTNLYTRTDTTTSVTTEDINRAFKPVIGPRPLVNGLQGRIDYYWS

VLKPGQTLRVRSNGNLIAPWYGHILSGESHGRILKSDLNSGNCVVQCQTERGGLNT

TLPFHNVSKYAFGNCPKYVGVKSLKLAVGMRNVPARSSRGLFGAIAGFIEGGWPG

LVAGWYGFQHSNDQGVGMAADRDSTQKAIDKITSKVNNIVDKMNKQYEIIDHEFS

EIETRLNMINNKIDDQIQDIWAYNAELLVLLENQKTLDEHDANVNNLYNKVKRALG

SNAMEDGKGCFELYHKCDDRCMETIRNGTYNRGKYKEESRLERQKIEGVKLESEG

TYKSGR*LVPRGS*PGSGYIPEAPRDGQAYVRKDGEWVLLSTFLGKPIPNPLLGLDSTGHH

HHHH

A/Hong Kong/1073/99 - H9N2

(SEQ ID NO: 744)

METISLITILLVVTASNADKICIGHQSTNSTETVDTLTETNVPVTHAKELLHTEHNG

MLCATSLGHPLILDTCTIEGLVYGNPSCDLLLGGREWSYIVERSSAVNGTCYPGNV

ENLEELRTLFSSASSYQRIQIFPDTTWNVTYTGTSRACSGSFYRSMRWLTQKSGFYP

VQDAQYTNNRGKSILFVWGIHHPPTYTEQTNLYIRNDTTTSVTTEDLNRTFKPVIGP

RPLVNGLQGRIDYYWSVLKPGQTLRVRSNGNLIAPWYGHVLSGGSHGRILKTDLK

GGNCVVQCQTEKGGLNSTLPFHNISKYAFGTCPKYVRVNSLKLAVGLRNVPARSSR

GLFGAIAGFIEGGWPGLVAGWYGFQHSNDQGVGMAADRDSTQKAIDKITSKVNNI

VDKMNKQYEIIDHEFSEVETRLNMINNKIDDQIQDVWAYNAELLVLLENQKTLDEH

DANVNNLYNKVKRALGSNAMEDGKGCFELYHKCDDQCMETIRNGTYNRRKYREE

SRLERQKIEGVKLESEGTYKSGR*LVPRGS*PGSGYIPEAPRDGQAYVRKDGEWVLLSTF

LGKPIPNPLLGLDSTGHHHHHH

The recombinant and soluble HA expression constructs of SEQ ID NO: 727-744 were transfected into 293 HEK cells. Recombinant HA0 protein or HA cleaved into its respective subunits HA1 and HA2 and disulphide linked was purified from culture supernatant by standard procedures using the hexa-HIS tag at the C-terminal. The purified protein was analyzed by size exclusion chromatography and/or denaturing coomasie gel to confirm a recombinant protein of the expected size was present.

Example 14

Screening of Antibodies in Peripheral Blood

One hundred and twenty-six individual serum or plasma samples were screened for the presence of IgG antibody that bound to recombinant soluble homotrimeric HA proteins (Table 9) using a micro-array scanning system, bind to whole inactivated Influenza A virions (Table 10) using standard ELISA techniques, and inhibits or neutralizes virus infection of MDCK cells with Influenza A H1N1 A/Solomon Islands/3/06 or H3N2 A/Wisconsin/67/05. A portion of the plasma samples contained IgG antibodies that bound specifically to the recombinant soluble HA homotrimeric protein, bound to inactivated virions, and neutralized virus infectivity. This indicates that the antibodies could be binding linear or discontinuous epitopes in the HA homotrimer, as well as binding to conformational determinants of multiple variants of the HA homotrimer. Soluble targets include, but are not limited to, exemplary recombinant HA proteins derived from the influenza virus strains listed in Table 2 and the inactivated virus strains listed in Table 11.

TABLE 11

Inactivated whole virions used in ELISA binding assays.

| Influenza A Subtype | Strain designation |
|---|---|
| H1N1 | A/Solomon Islands/3/06 |
| H2N2 | A/Japan/305/57 |
| H3N2 | A/Wisconsin/67/05 |

Example 15

Identification and Rescue of HA-Specific Antibodies

IgG+ memory B cells purified from a human blood sample were cultured for 9 days in order to activate, proliferate, and differentiate these memory B cells into IgG secreting plasma cells. The B cell culture media containing the IgG was screened for the presence of IgG antibody that bound to recombinant soluble homotrimeric HA proteins (Table 9) using a micro-array scanning system, bind to whole Influenza A virus (Table 10) using standard ELISA techniques, and inhibits or neutralizes virus infection of MDCK cells with Influenza A H1N1 A/Solomon Islands/3/06 or H3N2 A/Wisconsin/67/05. As shown in Tables 12, 13, and 14, thirty-nine BCC wells were identified that contained an IgG antibody with several virus, HA, or neutralizing profiles and the variable regions of the antibody were then cloned from the corresponding B cell cultures.

Transient transfections with monoclonal heavy and light chain pairs from each BCC well were performed in 293 6E cells to reconstitute and produce the antibody. Reconstituted antibody supernatants were then screened for IgG that binds to recombinant soluble homotrimeric HA proteins (Table 9) using a micro-array scanning system, bind to whole Influenza A virus (Table 11) using standard ELISA techniques, and inhibits or neutralizes virus infection of MDCK cells with Influenza A H1N1 A/Solomon Islands/3/06, and/or H1N1 A/California/04/09, and/or H3N2 A/Wisconsin/67/05 to identify the rescued anti-HA antibody. Binding and neutralization of the human IgG antibodies to the preceding targets is compared to the binding of the proprietary positive control antibody TCN-032 (specific for the N-terminal of the matrix 2 protein of influenza A, U.S. patent application Ser. No. 12/795,618) or to the binding of the broadly HA specific, non-neutralizing mAb TCN-504 (also known as 3251K17, and described herein), and the proprietary negative control antibody TCN-202 (specific for the AD2 site I epitope on human cytomegalovirus gB) to these same targets.

The sequences of the rescued antibodies are determined. In addition, the sequence of each of the polynucleotides encoding the antibody sequences is determined.

Example 16

Binding Profiles of IgG in B Cell Culture Supernatant or Monoclonal Transfection Supernatant Using Inactivated Whole Influenza A Virions To determine whether the human mAbs in BCC SN or monoclonal transfection supernatantbind to purified virus, Enzyme-Linked ImmunoSorbent Assays (ELISAs) were performed according to the following methods. Briefly, various purified Influenza A virus subtype strains were coated directly onto an ELISA plate. A single dilution of BCC supernatant of the mAbs shown in Table 12 or of the monoclonal transfection supernatant shown in Table 15 and various dilutions of a positive control antibody (TCN-032) were then added to the virus coated wells. Unbound antibody was washed away and the bound antibody was detected with an anti-human antibody conjugated to HRP. The presence of anti-influenza antibodies was detected when the chromogen (TMB) is oxidized by the HRP conjugate, resulting in a bluecolor. The reaction is stopped by the addition of HCl, turning antibody positive wells yellow. The yellow color has a maximal absorbance at 450 nm.

Methods:

Coat Microlon™ plates with 25 ul/well of 3 ug/ml inactivated influenza A virions Incubate plates overnight at 4° C.

Remove plates from 4° C. and wash four times with phosphate buffered saline with Calicum and Magnesium (PBS w/$Ca^{2+}$,$Mg^{2+}$), using EL405× (Wash program: ELISA_4×_ wash).

Add 20 ul/well of 1% milk/PBS to plates.

Prepare control mAb curves by 1:3 dilutions of 6 ug/ml 5 ul of each BCC SN or monoclonal transient transfection supernatant and control mAb curves are stamped onto the plate according to the plate map.

Incubate 2 hour (hr) at room temperature (RT).

Wash plates four times with PBS w/$Ca^{2+}$,$Mg^{2+}$, using EL405× (Wash program: ELISA_4×_wash)

Add 25 ul/well of polyclonal antibody (pAb) goat anti-human (αHuman) IgG Fc horseradish peroxidase (HRP) at a dilution of 1:5000.

Incubate 1 hr at RT.

Wash plates four times with PBS w/$Ca^{2+}$,$Mg^{2+}$, using EL405× (Wash program: ELISA_4×_wash)

Add 25 ul/well of Ultra-TMB (3,3',5,5'-tetramethylbenzidine) at Neat.

Develop 30 minutes (min) at RT.

Stop by adding 25 ul/well of hydrochloric acid (HCl) at a concentration of 0.3M.

Read the plate at 450 nm with the Spectromax.

One or more of the following control antibodies were used in these experiments: TCN-504 (also known as 3251_K17, and described herein) TCN-032 (also known as 8I10, specific for the influenza A M2 protein), and TCN-202 (also known as 2N9, specific for the AD2 site I epitope on human cytomegalovirus gB) protein.

The following purified viruses were used in these experiments: A/Solomon Islands/3/2006(H1N1) (SEQ ID NO: 728), A/Japan/305/1957(H2N2) (SEQ ID NO: 729), A/Wisconsin/67/2005(H3N2) (SEQ ID NO: 730). As shown in Table 15 the human monoclonal antibodies in the transient transfection supernatant bind strongly to one or more of the H1N1, H2N2, and/or H3N2 viruses reproducing the virus binding profile of the IgG antibody in the original BCC SN (Table 12).

Example 17

Binding Profiles of IgG in in B Cell Culture Supernatant or Monoclonal Transfection Supernatant Using Trimeric HA To determine whether the human mAbs in BCC SN or monoclonal transfection supernatant bind to one or more of the recombinant homotrimeric HA proteins, a micro-array scanning system was used according to the following methods. Twenty Nexterion P (Schott) glass slides are incubated overnight in a humid chamber with 3 mg/ml goat anti-human, Fc-specific antibody. Nexterion P slides contain a hydrogel that terminates in an NHS ester reactive group that binds the capture antibody. The reaction is then quenched using 50 mM ethanolamine in 50 mM NaBorate (pH 8.0) buffer for 1 hour with agitation followed by 3 washes with ultrapure water. Transfection supernatants are transferred to 384-well array source plates. Control array source plates are made in 8-point, 3-fold serial dilutions of antibody starting at 3 ug/ml and ending 0 ug/ml in BCC or mock transfection media. Both BCC or transfection supernatant array source plates and control plates are loaded onto an Aushon 2470 microarray printer along with the 20 prepared slides.

Microarrays are printed in 48 subarray blocks with variable number of features and replicates depending on number of transfection supernatants are being printed. Printed microarrays are allowed to sit for at least 1 hour after printing (to overnight) in the printer's humidity controlled chamber (80%). They are then quickly removed from the printer, washed, and spun dry to prepare the slides for sample incubations. A LifterSlip is placed on each slide and 90 uls of sample is added to each. Each slide receives either one of 18 V5-tagged HA trimerics at predetermined concentrations, a horseradish peroxidase goat anti-human H+L specific antibody at a 1 ug/ml, or a blank for a total of 20 slides. The slides are then incubated overnight in a humid chamber at room temperature. After washing, spin drying, and new LifterSlip application, 19 slides, excluding slide incubated with anti-human IgG, are incubated with anti-V5 conjugated to biotin at a 1:1000 dilution for 1 hour. Subsequently the slides are again washed, dried and prepared for an 1-hour incubation with a 1:300 dilution of NeutrAvidin-HRP. After further washing, drying and preparation all 20 slides are incubated for 1 hour with a Tyramide-AlexaFluor reagent according to kit instructions. After final washing and drying the slides are scanned on an Axon Genepix 4300A at an excitation wavelength of 594 nm and with an emission band ranging from 619 nm to 641 nm. Data is recovered using the Axon Genepix software and is then analyzed for binding profiles.

Methods:

1. Dilute goat anti-human, FC -specific antibody (Jacksonlmmuno, 10 mg/ml) to 3 mg/ml in PBS 0.05&Tween and apply to 20 Nexterion P Slides (Schott) using 90 uls under lifterslips (Thermo).
2. Incubate in a humid chamber overnight at room temperature
3. Removing the lifterslip quench all slides in 50 mM ethanolamine (Fisher)) in 50 mM Sodium tetraborate decahydrate (Fisher, S248-500) at a pH of 8.0
4. Quench for 1 hour with incubation at room temperature
5. Wash all slides (3×2 min MilliQ water washes with agitation).
6. Load all slides onto Aushon 2470 MicroArray printer.
7. Prepare control plates using by spiking control antibodies into transfection media to form an 8 point 3-fold serial dilution starting at 3 ug/ml and ending in 0 ug/ml. Transfer control dilutions to 4 array source plates (Thermo).
8. Load all array source plates, control and sample, onto Aushon 2470 microarray printer and begin deposition after checking all required fluid levels. Number of replicates is based on number of transfection supernatants being printed. Typically 1 to 10 replicates.
9. Allow slides to sit for at least an hour, to overnight, after deposition.
10. Immediately wash (PBS with 2% tween 20, 5 min; MilliQ water, 2 min, 3×) and spin dry (2000 RPM for 1 minute)
11. Using lifterslips and apply 90 uls of HA at the following concentration:

| Homotrimeric HA - strain | [ug/ml] |
|---|---|
| A/California/4/09 - H1N1 | 5 |
| A/Solomon Islands/3/06 - H1N1 | 5 |
| A/Japan/305/57 - H2N2 | 5 |
| A/Wisconsin/67/05 - H3N2 | 20 |
| A/swine/Ontario/01911-2/99 - H4N6 | 5 |
| A/Vietnam/1203/04 - H5N1 | 20 |
| A/Indonesia/5/05 - H5N1 | 0.5 |
| A/Egypt/3300-NAMRU3/08 - H5N1 | 0.5 |
| A/Common magpie/Hong Kong/5052/07 - H5N1 | 0.5 |
| A/Anhui/1/05 - H5N1 | 0.5 |
| A/chicken/Vietnam/NCVD-016/08 - H5N1. | 0.5 |
| A/northern shoveler/California/HKWF115/2007 - H6N1 | 0.5 |
| A/Netherlands/219/03 - H7N7 | 0.5 |
| A/duck/Yangzhou/02/2005 - H8N4 | 5 |
| A/Hong Kong/2108/03 - H9N2 | 5 |
| A/South Carolina/1/18 - H1N1 | 20 |
| A/Hong Kong/1073/99 | 20 |
| A/Hong Kong/156/97 - H5N1 | 5 |

Use 1× PBS, 0.05% Tween 20, 10% Blocker Casein (Thermo, #37528) to bring the homotrimeric HA to the desired concentration.

12. Incubate overnight in a humid chamber at room temperature
13. Immediately wash (PBS with 2% tween 20, 5 min; MilliQ water, 2 min, 3×) and spin dry (2000 RPM for 1 minute)
14. Using lifterslips incubate all but slide previously incubated with anti-human IgG(H&L)-HRP with 90 uls of anti-V5-biotin (AbD Serotec, MCA1360B) at 1 ug/ml in 1× PBS 0.05% Tween 20 for 1 hour at room temperature in a humid chamber.
15. Immediately wash (PBS with 2% tween 20, 5 min; MilliQ water, 2 min, 3×) and spin dry (2000 RPM for 1 minute)
16. Using lifterslips incubate with 90 uls of horseradish peroxidase conjugated NeutrAvidin (Pierce #31030) for 1 hour at room temperature in a humid chamber.

17. Immediately wash (PBS with 2% tween 20, 5 min; MilliQ water, 2 min, 3×) and spin dry (2000 RPM for 1 minute)
18. Prepare Tyramide Signal Amplification reagent according to kit instructions (TSA Kit #25, Invitrogen, T20935). Briefly dilute 1 ul of hydrogen peroxide solution into 200 uls of amplification buffer. Take 20 uls of hydrogen peroxide/amplification buffer solution and add to 1940 uls of fresh amplification buffer. Then add 40 uls of tyramide-Alexa Fluor resulting in a total of 2 mls of amplification reagent
19. Incubate all 20 slides with amplification reagent for 1 hour at room temperature in a humid chamber.
20. Immediately wash (PBS with 2% tween 20, 5 min; MilliQ water, 2 min, 3×) and spin dry (2000 RPM for 1 minute)
21. Scan all slides on an Axon Genepix 4300A at an excitation wavelength of 594 nm and with an emission band ranging from 619 nm to 641 nm or optical scanner with similar capabilities.
22. Lay templates on each slide using GenePix Pro 7 or similar software to recover feature data.
23. Analyze feature data for binding profiles to each HA trimeric.

As shown in Table 16, the human monoclonal antibodies in the transient transfection supernatant bind strongly to one or more of the recombinant homotrimeric HA proteins reproducing the virus binding profile of the IgG antibody in the original BCC SN (Table 12).

Example 18

Neutralization Profiles of IgG in in B Cell Culture Supernatant or Monoclonal Transfection Supernatant MDCK cells were plated at $3\times10^3$ cells/well in a 384-well plate in complete DMEM media (supplemented with 10% FBS, 1× penicillin/streptomycin, 1× Glutamax™, and 1× Sodium Pyruvate) and incubated at 37° C. overnight.

Influenza A virus was preincubated with either BCC supernatant or monoclonal transfection supernatant or a positive control neutralizing monoclonal antibody (MAb), which was diluted in pooled BCC supernatant or in mock transfection supernatant at the desired concentrations and incubated overnight (~16 hours) at 37° C. Void volumes and dilutions were made in PBS with $Mg^{2+}$, $Ca^{2+}$, 200 mM Mannose, and 1% BSA at 37° C. with a total volume of 30 μl/well.

Each sample well contained:

(a) 20 μl/well BCC supernatant; or (b) 20 ul/well of monoclonal transfection (c) 3000 IU/well A/Solomon Islands/03/2006 (H1N1) in 10 μl/well; or (e) 3000 IU/well A/California/04/2009 (H1N1) in 10 μl/well; or (f) 3000 IU/well A/Wisconsin/67/05 (H3N2) in 10 ul/well Prior to infection, the MDCK cells were washed once with a solution containing PBS, $Mg^{2+}$, and $Ca^{2+}$ at 60 μl/well. After the wash, 25 ul of the virus/mAb mixture was transferred and the infection proceeded for 4 hours at 37° C.

After 4 hours of infection, the MDCK cells are washed twice with complete DMEM. After the last wash, 25 μl/well of complete DMEM remained, and the plates were incubated overnight at 37° C.

After the overnight incubation the culture media was removed and 20 μl of BD Cytofix/Cytoperm™ (cat #51-2090KZ) was added to each well and incubated at room temperature (RT) for 30 minutes. Next, the wells were washed three times using the M384 Atlas plate washer.

After the final wash, 15 μl/well of 100 μg/ml Rabbit IgG (Sigma) in PBS with $Mg^{2+}$, $Ca^{2+}$, and 1% BSA, was added and incubated for at least 5 minutes at RT. Twenty μl/well of anti-M2e mAb TCN-032 at 2 μg/ml in PBS with $Mg^{2+}$, $Ca^{2+}$, and 1% BSA, were added to each well and incubated for at least 30 mins at room temperature. The wells are washed one time using the Atlas plate washer with PBS with $Mg^{2+}$, $Ca^{2+}$ Twenty μl/well of 2 μg/ml Alexa Fluor® 647 anti-Human IgG H+L (Invitrogen™) and 20 μg/ml Hoechst 33342 (Invitrogen™) was added and incubated in the dark for 45 mins at room temperature. Wells were washed three timesusing the Atlas plate washer with PBS with $Mg^{2+}$, $Ca^{2+}$. Twenty microliters of PBS with $Mg^{2+}$, $Ca^{2+}$, and 1% BSA was added to each well, and plates were sealed with black sealing tape. Plates were analyzed by scanning using an IN Cell analyzer. Specifically, the scan was performed using the IN Cell Developer Software, Protocol "384 GG Hoechst AF647 4×." Analysis of the scan was performed using the Developer Tool Box software, Protocol "Cellular Binding Nuclei GG Density 4."

The assay was able to detect well supernatants that individually neutralized the Influenza A infection. If an arbitrary cutoff was established at ≤150 nucleoprotein (NP)+ cells and the wells with a disrupted cell monolayer were subtracted, a total of 122 wells scored as positive.

Exemplary influenza neutralizing antibodies that were identified using this method are TCN-522 (3212_I12), TCN-521 (3280_D18), TCN-523 (5248_A17), TCN-563 (5237_B21), TCN-526 (5084_C17), TCN-527 (5086_C06), TCN-528 (5087_P17), TCN-529 (5297_H01), TCN-530 (5248_H10a), TCN-531 (5091_H13), TCN-532 (5262_H18), TCN-533 (5256_A17), TCN-534 (5249_B02), TCN-535 (5246_P19), TCN-536 (5095_N01), TCN-537 (3194_D21), TCN-538 (3206_O17), TCN-539 (5056_A08), TCN-540 (5060_F05), TCN-541 (5062_M11), TCN-542 (5079_A16), TCN-543 (5081_G23), TCN-544 (5082_A19), TCN-545 (5082_I15), TCN-546 (5089_L08), TCN-547 (5092_F11), TCN-548 (5092_P01), TCN-549 (5092_P04), TCN-550 (5096_F06), TCN-551 (5243_D01), TCN-552 (5249_I23), TCN-553 (5261_C18), TCN-554 (5277_M05), TCN-555 (5246_L16), TCN-556 (5089_K12), TCN-557 (5081_A04), TCN-558 (5248_H10b), TCN-559 (5097_G08), TCN-560 (5084_P10), and TCN-504 (3251_K17). The individual neutralization activities of some of these antibodies are provided in Table 17.

Several antibodies were identified that may be non-neutralizing, including, TCN-504 (3251_K17), TCN-556 (5089_K12), TCN-557 (5081_A04), TCN-559 (5097_G08), and TCN-560 (5084_P10). These antibodies, similar to the neutralizing antibodies of the invention, bind to a broad range of HA proteins, including sequence and conformational variants. In certain embodiments of the invention, non-neutralizing antibodies, including TCN-504 (3251_K17), TCN-556 (5089_K12), TCN-557 (5081_A04), TCN-559 (5097_G08), and TCN-560 (5084_P10) may be used as antibody-drug conjugates.

TABLE 12

Summary of BCC SN screening by ELISA for virus binding.

| | | ELISA: Virus Binding ($OD_{450}$) | | |
|---|---|---|---|---|
| Theraclone mAb ID | BCC well ID | A/Solomon Islands/ 3/06 H1N1 | A/Japan/ 305/57 H2N2 | A/Wisconsin/ 67/05 H3N2 |
| TCN-521 | 3280_D18 | 3.70 | 3.10 | 1.10 |
| TCN-522 | 3212_I12 | 2.12 | ND | 0.07 |

TABLE 12-continued

Summary of BCC SN screening by ELISA for virus binding.

| Theraclone mAb ID | BCC well ID | ELISA: Virus Binding (OD₄₅₀) A/Solomon Islands/ 3/06 H1N1 | A/Japan/ 305/57 H2N2 | A/Wisconsin/ 67/05 H3N2 |
|---|---|---|---|---|
| TCN-523 | 5248_A17 | 3.47 | 1.62 | 0.08 |
| TCN-563 | 5237_B21 | 3.62 | 1.23 | 0.07 |
| TCN-526 | 5084_C17 | 0.06 | 0.07 | 3.65 |
| TCN-527 | 5086_C06 | 3.03 | 1.48 | 0.07 |
| TCN-528 | 5087_P17 | 3.62 | 2.82 | 0.24 |
| TCN-529 | 5297_H01 | 0.07 | ND | 3.62 |
| TCN-530 | 5248_H10 | 3.52 | 1.73 | 0.06 |
| TCN-531 | 5091_H13 | 3.23 | 0.67 | 3.45 |
| TCN-532 | 5262_H18 | 0.06 | 0.07 | 3.67 |
| TCN-533 | 5256_A17 | 3.54 | 1.10 | 0.10 |
| TCN-534 | 5249_B02 | 3.55 | 2.56 | 0.07 |
| TCN-535 | 5246_P19 | 3.43 | 1.46 | 0.08 |
| TCN-536 | 5095_N01 | 3.63 | 0.08 | 3.66 |
| TCN-537 | 3194_D21 | 3.24 | ND | 0.06 |
| TCN-538 | 3206_O17 | 3.47 | ND | 0.07 |
| TCN-539 | 5056_A08 | 0.06 | 0.06 | 2.85 |
| TCN-540 | 5060_F05 | 0.07 | 3.62 | 3.65 |
| TCN-541 | 5062_M11 | 3.44 | 0.06 | 0.25 |
| TCN-542 | 5079_A16 | 3.66 | 0.08 | 3.13 |
| TCN-543 | 5081_G23 | 3.63 | 3.62 | 0.07 |
| TCN-544 | 5082_A19 | 0.32 | 0.07 | 2.71 |
| TCN-545 | 5082_I15 | 3.32 | 0.06 | 0.47 |
| TCN-546 | 5089_L08 | 1.95 | 0.06 | 3.69 |
| TCN-547 | 5092_F11 | 0.06 | 0.07 | 3.68 |
| TCN-548 | 5092_P01 | 0.09 | 0.09 | 3.62 |
| TCN-549 | 5092_P04 | 0.09 | 0.08 | 3.58 |
| TCN-550 | 5096_F06 | 0.06 | 0.06 | 3.65 |
| TCN-551 | 5243_D01 | 3.35 | 0.19 | 0.07 |
| TCN-552 | 5249_I23 | 3.57 | 0.71 | 0.06 |
| TCN-553 | 5261_C18 | 3.60 | 2.54 | 0.07 |
| TCN-554 | 5277_M05 | 0.06 | ND | 1.09 |
| TCN-555 | 5246_L16 | 2.89 | 0.60 | 0.06 |
| TCN-556 | 5089_K12 | 2.70 | 2.41 | 0.06 |
| TCN-557 | 5081_A04 | 2.32 | 2.70 | 0.07 |
| TCN-559 | 5097_G08 | 3.68 | 1.25 | 0.70 |
| TCN-560 | 5084_P10 | 3.63 | 2.07 | 0.07 |
| TCN-202 | 2N9 | ND | ND | ND |
| TCN-504 | 3251_K17 | ND | ND | ND |
| TCN-032 | 8I10 | 3.61 | 3.61 | 3.62 |

TABLE 13

Summary of BCC SN screening for virus binding to recombinant homotrimeric HA.

| Theraclone mAb ID | BCC well ID | Trimeric HA Binding: RLU | | | | | | | | |
|---|---|---|---|---|---|---|---|---|---|---|
| | | A/ California/ 4/09 H1N1 | A/ Solomon Islands/ 3/06 H1N1 | A/ South Carolina/ 1/18 H1N1 | A/ Japan/ 305/57 H2N2 | A/ Wisconsin/ 67/05 H3N2 | A/ swine/ Ontario/ 01911-2/ 99 H4N6 | A/ Vietnam/ 1203/ 04 H5N1 | A/ Indonesia/ 5/05 H5N1 | A/ Egypt/ 3300- NAMRU3/ 08 H5N1 |
| TCN-521 | 3280_D18 | 25726 | 39644 | ND | 6732 | 2298 | 210 | 196 | 31473 | 47871 |
| TCN-522 | 3212_I12 | 5019 | 38914 | ND | 989 | 302 | 156 | 145 | 67 | ND |
| TCN-523 | 5248_A17 | 34721 | 37916 | ND | 5111 | 22568 | 1288 | 3383 | 45815 | 36471 |
| TCN-563 | 5237_B21 | 45157 | 30005 | ND | 6612 | 40848 | 4501 | 4836 | 39533 | 27514 |
| TCN-526 | 5084_C17 | 203 | 341 | ND | 246 | 49312 | 253 | 372 | 46027 | ND |
| TCN-527 | 5086_C06 | 27991 | 16507 | ND | 19261 | 5715 | 7686 | 21264 | 23838 | ND |
| TCN-528 | 5087_P17 | 48845 | 44804 | ND | 46393 | 48795 | 47500 | 45577 | 42801 | ND |
| TCN-529 | 5297_H01 | 434 | 179 | ND | 435 | 51631 | 235 | 101 | 44085 | 53394 |
| TCN-530 | 5248_H10 | 46600 | 32801 | ND | 47049 | 36846 | 2743 | 7152 | 39774 | 30430 |
| TCN-531 | 5091_H13 | 22207 | 51663 | ND | 410 | 7094 | 408 | 357 | 37443 | ND |
| TCN-532 | 5262_H18 | 135 | 327 | ND | 176 | 18046 | 119 | 440 | 27992 | 24500 |
| TCN-533 | 5256_A17 | 29280 | 39186 | ND | 10846 | 13823 | 1582 | 5677 | 44063 | 34299 |
| TCN-534 | 5249_B02 | 30109 | 44185 | ND | 50626 | 7978 | 683 | 3435 | 46352 | 41381 |
| TCN-535 | 5246_P19 | 48576 | 39442 | ND | 26068 | 34320 | 5950 | 4740 | 45592 | 39412 |
| TCN-536 | 5095_N01 | 151 | 150 | ND | 121 | 34996 | 79 | 146 | 3969 | ND |
| TCN-537 | 3194_D21 | 21918 | 44264 | ND | 44685 | 549 | 19 | 80 | 14858 | 38168 |
| TCN-538 | 3206_O17 | 13808 | 33228 | ND | 43002 | 6900 | 406 | 60 | 26421 | 23553 |
| TCN-539 | 5056_A08 | 1803 | 239 | ND | 468 | 715 | 1579 | 545 | 49 | 11420 |
| TCN-540 | 5060_F05 | 57 | 64 | ND | 2969 | 728 | 178 | 63 | 31 | 1968 |
| TCN-541 | 5062_M11 | 34 | 51 | ND | 83 | 2923 | 102 | 43 | 30 | 1162 |
| TCN-542 | 5079_A16 | 3108 | 132 | ND | 142 | 1940 | 350 | 306 | ND | ND |
| TCN-543 | 5081_G23 | 13080 | 511 | ND | 197 | 1358 | 428 | 488 | ND | ND |
| TCN-544 | 5082_A19 | 281 | 179 | ND | 187 | 2090 | 316 | 349 | 3052 | ND |
| TCN-545 | 5082_I15 | 365 | 266 | ND | 157 | 575 | 289 | 235 | ND | ND |
| TCN-546 | 5089_L08 | 350 | 256 | ND | 520 | 30209 | 587 | 349 | 18432 | ND |
| TCN-547 | 5092_F11 | 170 | 155 | ND | 40 | 16932 | 252 | 308 | 6986 | ND |
| TCN-548 | 5092_P01 | 234 | 283 | ND | 416 | 48600 | 240 | 270 | 17626 | ND |
| TCN-549 | 5092_P04 | 338 | 284 | ND | 387 | 30912 | 421 | 312 | 11445 | ND |
| TCN-550 | 5096_F06 | 454 | 204 | ND | 201 | 26315 | 195 | 277 | 9100 | ND |
| TCN-551 | 5243_D01 | 53362 | 53821 | ND | 22832 | 6840 | 733 | 4152 | 53543 | 47183 |
| TCN-552 | 5249_I23 | 35312 | 39314 | ND | 23832 | 14769 | 493 | 2728 | 43559 | 39971 |
| TCN-553 | 5261_C18 | 20281 | 16271 | ND | 25509 | 20043 | 2583 | 6560 | 24406 | 18828 |
| TCN-554 | 5277_M05 | 173 | 115 | ND | 328 | 46531 | 78 | 113 | 32348 | 36126 |
| TCN-555 | 5246_L16 | 44903 | 26404 | ND | 2131 | 9800 | 1953 | 876 | 34539 | 42676 |
| TCN-556 | 5089_K12 | 14640 | 2846 | ND | 5611 | 9323 | 5604 | 13823 | 8454 | ND |
| TCN-557 | 5081_A04 | 17603 | 40699 | ND | 43367 | 10218 | 26967 | 47282 | 45165 | ND |

TABLE 13-continued

Summary of BCC SN screening for virus binding to recombinant homotrimeric HA.

| |

TABLE 14-continued

Summary of BCC SN screening for virus neutralization.

| Theraclone mAb ID | BCC well ID | % Neutralization A/Solomon Islands/ 3/06 H1N1 | % Neutralization A/Wisconsin/ 67/05 H3N2 |
|---|---|---|---|
| TCN-534 | 5249_B02 | 86 | 0 |
| TCN-535 | 5246_P19 | 82 | 1 |
| TCN-536 | 5095_N01 | 75 | 100 |
| TCN-537 | 3194_D21 | 89 | 5 |
| TCN-538 | 3206_O17 | 35 | 0 |
| TCN-539 | 5056_A08 | 97 | 62 |
| TCN-540 | 5060_F05 | 100 | 75 |
| TCN-541 | 5062_M11 | 89 | 99 |
| TCN-542 | 5079_A16 | 98 | 51 |
| TCN-543 | 5081_G23 | 100 | 55 |
| TCN-544 | 5082_A19 | 95 | 62 |
| TCN-545 | 5082_I15 | 98 | 72 |
| TCN-546 | 5089_L08 | 0 | 100 |
| TCN-547 | 5092_F11 | 0 | 100 |
| TCN-548 | 5092_P01 | 0 | 97 |
| TCN-549 | 5092_P04 | 0 | 99 |
| TCN-550 | 5096_F06 | 0 | 100 |
| TCN-551 | 5243_D01 | 100 | 19 |
| TCN-552 | 5249_I23 | 57 | 0 |
| TCN-553 | 5261_C18 | 87 | 0 |
| TCN-554 | 5277_M05 | 42 | 100 |
| TCN-555 | 5246_L16 | 48 | ND |
| TCN-556 | 5089_K12 | 0 | 4 |
| TCN-557 | 5081_A04 | 0 | 2 |
| TCN-559 | 5097_G08 | 82 | ND |
| TCN-560 | 5084_P10 | 94 | ND |
| TCN-202 | 2N9 | ND | ND |
| TCN-504 | 3251_K17 | ND | ND |
| TCN-032 | 8I10 | ND | ND |

TABLE 15

Summary of monoclonal antibody transfection supernatant screening by ELISA for virus binding.

| | Theraclone mAb ID | BCC well ID | ELISA: Virus Binding (OD$_{450}$) A/Solomon Islands/ 3/06 H1N1 | A/Japan/ 305/57 H2N2 | A/Wisconsin/ 67/05 H3N2 |
|---|---|---|---|---|---|
| Monoclonal transfection set 1 | TCN-523 | 5248_A17 | 3.59 | 1.69 | 0.09 |
| | TCN-504 | 3251_K17 | 3.65 | 3.65 | 3.65 |
| | TCN-202 | 2N9 | 0.07 | 0.07 | 0.07 |
| Monoclonal transfection | TCN-522 | 3212_I12 | 3.48 | 0.61 | 0.07 |
| | TCN-526 | 5084_C17 | 0.08 | 0.07 | 0.31 |
| set 2 | TCN-527 | 5086_C06 | 3.69 | 3.63 | 0.14 |
| | TCN-528 | 5087_P17 | 3.66 | 3.64 | 0.23 |
| | TCN-563 | 5237_B21 | 3.60 | 0.84 | 0.09 |
| | TCN-504 | 3251_K17 | 3.65 | 3.62 | 3.65 |
| | TCN-523 | 5248_A17 | 3.67 | 1.39 | 0.09 |
| | TCN-202 | 2N9 | 0.08 | 0.07 | 0.07 |
| Monoclonal transfection set 3 | TCN-531 | 5091_H13 | 0.10 | 0.09 | 3.59 |
| | TCN-530 | 5248_H10 | 3.62 | 3.43 | 0.21 |
| | TCN-529 | 5297_H01 | 0.16 | 0.10 | 3.65 |
| | TCN-533 | 5256_A17 | 3.61 | 3.65 | 0.22 |
| | TCN-532 | 5262_H18 | 0.13 | 0.08 | 3.43 |
| | TCN-504 | 3251_K17 | 3.63 | 3.64 | 3.65 |
| | TCN-523 | 5248_A17 | 3.59 | 3.47 | 0.15 |
| | TCN-202 | 2N9 | 0.10 | 0.08 | 0.08 |
| Monoclonal transfection set 4 | TCN-535 | 5246_P19 | 3.52 | 2.45 | 0.10 |
| | TCN-534 | 5249_B02 | 3.50 | 2.45 | 0.08 |
| | TCN-536 | 5095_N01 | 3.52 | 0.06 | 3.61 |
| | TCN-504 | 3251_K17 | 3.52 | 3.51 | 3.59 |
| | TCN-523 | 5248_A17 | 3.43 | 1.73 | 0.09 |
| | TCN-202 | 2N9 | 0.10 | 0.08 | 0.07 |
| Monoclonal transfection set 5 | TCN-537 | 3194_D21 | 3.56 | 3.48 | 0.11 |
| | TCN-538 | 3206_O17 | 3.59 | 3.37 | 0.12 |
| | TCN-539 | 5056_A08 | 0.07 | 0.07 | 0.13 |
| | TCN-540 | 5060_F05 | 0.09 | 3.61 | 3.62 |
| | TCN-541 | 5062_M11 | 3.63 | 0.07 | 0.07 |
| | TCN-542 | 5079_A16 | 3.60 | 0.07 | 0.23 |
| | TCN-543 | 5081_G23 | 3.63 | 3.64 | 2.23 |
| | TCN-544 | 5082_A19 | 0.07 | 0.07 | 3.65 |
| | TCN-545 | 5082_I15 | 1.36 | 0.10 | 3.62 |
| | TCN-546 | 5089_L08 | 3.67 | 0.07 | 3.67 |
| | TCN-547 | 5092_F11 | 0.09 | 0.09 | 0.13 |
| | TCN-548 | 5092_P01 | 0.13 | 0.09 | 3.63 |
| | TCN-549 | 5092_P04 | 0.09 | 0.08 | 0.46 |
| | TCN-550 | 5096_F06 | 0.13 | 0.08 | 3.62 |
| | TCN-551 | 5243_D01 | 3.65 | 0.10 | 0.27 |
| | TCN-552 | 5249_I23 | 3.61 | 2.68 | 0.27 |
| | TCN-553 | 5261_C18 | 3.56 | 3.28 | 0.17 |
| | TCN-554 | 5277_M05 | 0.18 | 0.11 | 3.40 |
| | TCN-555 | 5246_L16 | 3.57 | 2.10 | 0.13 |
| | TCN-556 | 5089_K12 | 3.64 | 3.64 | 0.34 |
| | TCN-557 | 5081_A04 | 3.58 | 3.59 | 3.47 |
| | TCN-558 | 5248_H10 | 3.52 | 3.31 | 0.20 |
| | TCN-559 | 5097_G08 | 1.16 | 2.29 | 2.39 |
| | TCN-560 | 5084_P10 | 3.52 | 3.55 | 0.30 |
| | TCN-504 | 3251_K17 | 3.60 | 3.59 | 3.60 |
| | TCN-523 | 5248_A17 | 3.62 | 2.56 | 0.14 |
| | TCN-202 | 2N9 | 0.07 | 0.07 | 0.07 |

TABLE 16

Summary of monoclonal antibody transfection supernatant screening for virus binding to recombinant homotrimeric HA.

| | Theraclone mAb ID | BCC well ID | Trimeric HA Binding: RLU A/California/ 4/09 H1N1 | A/Solomon Islands/ 3/06 H1N1 | A/South Carolina/ 1/18 H1N1 | A/Japan/305/ 57 H2N2 | A/Wisconsin/ 67/05 H3N2 | A/swine/ Ontario/ 01911-2/ 99 H4N6 | A/Vietnam/ 1203/04 H5N1 | A/Indonesia/ 5/05 H5N1 |
|---|---|---|---|---|---|---|---|---|---|---|
| Monoclonal transfection set 1 | TCN-523 | 5248_A17 | 17703 | 6785 | 26364 | 191 | 1646 | 49 | 80 | 18508 |
| | TCN-504 | 3251_K17 | 18286 | 29844 | 21541 | 15059 | 14311 | 26491 | 1300 | 16640 |
| | TCN-202 | 2N9 | 20 | 67 | 32 | 27 | 27 | 29 | 37 | 57 |

TABLE 16-continued

Summary of monoclonal antibody transfection supernatant screening for virus binding to recombinant homotrimeric HA.

| | | | | | | | | | | |
|---|---|---|---|---|---|---|---|---|---|---|
| Monoclonal transfection set 2 | TCN-522 | 3212_I12 | 37463 | 17281 | 39613 | 11936 | 3346 | 1048 | 48169 | 50472 |
| | TCN-526 | 5084_C17 | 3598 | 1468 | 2312 | 3592 | 27776 | 3487 | 9181 | 37831 |
| | TCN-527 | 5086_C06 | 21498 | 19685 | 48062 | 20758 | 35796 | 30085 | 20600 | 23433 |
| | TCN-528 | 5087_P17 | 44586 | 26908 | 25226 | 23083 | 46012 | 49173 | 23336 | 39704 |
| | TCN-563 | 5237_B21 | 21231 | 26475 | 17808 | 11198 | 23686 | 2248 | 31549 | 47277 |
| | TCN-504 | 3251_K17 | 15621 | 31447 | 24695 | 22573 | 21615 | 32496 | 14953 | 19717 |
| | TCN-523 | 5248_A17 | 18654 | 3270 | 25504 | 882 | 2062 | 82 | 26227 | 24527 |
| | TCN-202 | 2N9 | 52 | 16 | 195 | 32 | 46 | 15 | 121 | 8 |
| Monoclonal transfection set 3 | TCN-531 | 5091_H13 | 2830 | 194 | 1557 | 489 | 4159 | 296 | 2411 | 54 |
| | TCN-530 | 5248_H10 | 21176 | 13820 | 17166 | 5174 | 3048 | 123 | 25172 | 25546 |
| | TCN-529 | 5297_H01 | 735 | 43 | 158 | 45 | 2939 | 45 | 415 | 1353 |
| | TCN-533 | 5256_A17 | 6877 | 15526 | 16417 | 18618 | 16132 | 180 | 11677 | 28339 |
| | TCN-532 | 5262_H18 | 23601 | 59 | 311 | 441 | 9967 | 29 | 452 | 2786 |
| | TCN-504 | 3251_K17 | 18614 | 32672 | 27617 | 35957 | 21437 | 34456 | 13284 | 18559 |
| | TCN-523 | 5248_A17 | 19366 | 11014 | 23710 | 4554 | 8558 | 1640 | 22129 | 21973 |
| | TCN-202 | 2N9 | 205 | 57 | 731 | 42 | 51 | 54 | 967 | 43 |
| Monoclonal transfection set 4 | TCN-535 | 5246_P19 | 25157 | 836 | 22433 | 21491 | 4450 | 138 | 25244 | 18202 |
| | TCN-534 | 5249_B02 | 27035 | 60 | 11830 | 14745 | 897 | 264 | 23675 | 948 |
| | TCN-536 | 5095_N01 | 49 | 30 | 39 | 260 | 20576 | 168 | 182 | 80 |
| | TCN-504 | 3251_K17 | 549 | 14625 | 21713 | 19576 | 20627 | 21792 | 25665 | 18154 |
| | TCN-523 | 5248_A17 | 28847 | 371 | 22983 | 3845 | 9742 | 850 | 30898 | 24534 |
| | TCN-202 | 2N9 | 94 | 34 | 27 | 334 | 125 | 157 | 67 | 19 |
| Monoclonal transfection set 5 | TCN-537 | 3194_D21 | 33793 | 760 | 46788 | 16197 | 1935 | 3282 | 50280 | 2420 |
| | TCN-538 | 3206_O17 | 15956 | 1965 | 8434 | 6624 | 2070 | 3354 | 52375 | 13748 |
| | TCN-539 | 5056_A08 | 1053 | 871 | 5330 | 2565 | 58831 | 6511 | 53254 | 8947 |
| | TCN-540 | 5060_F05 | 984 | 1176 | 1356 | 47894 | 52986 | 5419 | 42500 | 2569 |
| | TCN-541 | 5062_M11 | 1557 | 2277 | 2583 | 5382 | 1238 | 4724 | 45517 | 2959 |
| | TCN-542 | 5079_A16 | 667 | 48021 | 1116 | 5184 | 711 | 14340 | 29492 | 1761 |
| | TCN-543 | 5081_G23 | 2338 | 43523 | 28290 | 2775 | 37048 | 2866 | 33145 | 1826 |
| | TCN-544 | 5082_A19 | 706 | 997 | 1331 | 1003 | 38514 | 2391 | 38620 | 4400 |
| | TCN-545 | 5082_I15 | 818 | 951 | 900 | 1355 | 32037 | 2936 | 42906 | 5269 |
| | TCN-546 | 5089_L08 | 1085 | 1140 | 955 | 1730 | 28453 | 4609 | 47108 | 40866 |
| | TCN-547 | 5092_F11 | 1474 | 1082 | 2016 | 1354 | 6968 | 1602 | 27666 | 12041 |
| | TCN-548 | 5092_P01 | 818 | 750 | 1154 | 1016 | 34194 | 1624 | 23678 | 29142 |
| | TCN-549 | 5092_P04 | 622 | 640 | 2340 | 1075 | 51626 | 1878 | 32265 | 8645 |
| | TCN-550 | 5096_F06 | 628 | 758 | 1014 | 731 | 37809 | 1704 | 41900 | 9001 |
| | TCN-551 | 5243_D01 | 46133 | 43523 | 4344 | 25191 | 936 | 3120 | 41915 | 1289 |
| | TCN-552 | 5249_I23 | 23459 | 48559 | 37374 | 51986 | 18451 | 9084 | 18494 | 43382 |
| | TCN-553 | 5261_C18 | 23323 | 49581 | 41300 | 39848 | 25248 | 12230 | 19214 | 31183 |
| | TCN-554 | 5277_M05 | 4034 | 992 | 1261 | 2621 | 25329 | 5402 | 36582 | 44935 |
| | TCN-555 | 5246_L16 | 20223 | 44571 | 48009 | 16743 | 14660 | 4522 | 19300 | 33927 |
| | TCN-556 | 5089_K12 | 20865 | 23409 | 32732 | 22805 | 44715 | 19346 | 17421 | 15229 |
| | TCN-557 | 5081_A04 | 44419 | 26960 | 44865 | 27282 | 46082 | 41525 | 21320 | 22246 |
| | TCN-558 | 5248_H10 | 20220 | 36107 | 40709 | 34434 | 26611 | 10003 | 23527 | 24632 |
| | TCN-559 | 5097_G08 | 8079 | 41254 | 2233 | 46993 | 15279 | 35761 | 37607 | 51869 |
| | TCN-560 | 5084_P10 | 31134 | 22427 | 30462 | 25855 | 55383 | 16751 | 19475 | 16971 |
| | TCN-504 | 3251_K17 | 17599 | 30086 | 31975 | 23254 | 38088 | 54789 | 21485 | 18485 |
| | TCN-523 | 5248_A17 | 34415 | 37587 | 52010 | 22019 | 13690 | 1699 | 27819 | 55048 |
| | TCN-202 | 2N9 | 733 | 525 | 5331 | 1883 | 581 | 2692 | 30002 | 1973 |

| | | Trimeric HA Binding: RLU | | | | | | | | | |
|---|---|---|---|---|---|---|---|---|---|---|---|
| | Theraclone mAb ID | A/Egypt/3300-NAMRU3/08 H5N1 | A/common magpie/Hong Kong/5052/07 H5N1 | A/Anhui/1/05 H5N1 | A/chicken/Vietnam/NCVD-016/08 H5N1 | A/Hong Kong/156/97 H5N1 | A/northern shoveler/California/HKWF115/07 H6N4 | A/Netherlands/219/03 H7N7 | A/duck/Yangzhou/02/05 H8N4 | A/Hong Kong/2108/03 H9N2 | A/Hong Kong/1073/99 H9N2 |
| Monoclonal transfection set 1 | TCN-523 | 25494 | 6235 | 60 | 10813 | ND | 9046 | 28 | 229 | 41 | 21719 |
| | TCN-504 | 16113 | 29696 | 29046 | 27765 | ND | 5791 | 23828 | 28934 | 78 | 25703 |
| | TCN-202 | 76 | 21 | 20 | 14 | ND | 13 | 55 | 26 | 24 | 21 |
| Monoclonal transfection set 2 | TCN-522 | 55413 | 21393 | 2031 | 49343 | ND | 54364 | 2170 | 1646 | 203 | 11800 |
| | TCN-526 | 39894 | 1758 | 43991 | 3294 | ND | 3789 | 5659 | 4305 | 23267 | 490 |
| | TCN-527 | 23595 | 43794 | 15238 | 20112 | ND | 19272 | 49149 | 17921 | 25527 | 557 |
| | TCN-528 | 36834 | 45257 | 21207 | 22573 | ND | 28370 | 47229 | 19792 | 33621 | 322 |
| | TCN-563 | 23915 | 52783 | 1568 | 36304 | ND | 21901 | 5423 | 6275 | 364 | 49230 |
| | TCN-504 | 21365 | 16850 | 30975 | 27266 | ND | 1277 | 19272 | 17751 | 23 | 25832 |
| | TCN-523 | 30672 | 7214 | 139 | 17590 | ND | 21214 | 407 | 383 | 18 | 31283 |
| | TCN-202 | 18 | 11 | 9 | 22 | ND | 30 | 26 | 19 | 7 | 33 |
| Monoclonal transfection set 3 | TCN-531 | 363 | 37 | 76 | 44 | ND | 96 | 384 | 3220 | 158 | 370 |
| | TCN-530 | 25523 | 5576 | 97 | 17979 | ND | 23513 | 118 | 227 | 44 | 10219 |
| | TCN-529 | 1673 | 33 | 1258 | 33 | ND | 110 | 33 | 48 | 1197 | 46 |
| | TCN-533 | 18587 | 25210 | 301 | 24551 | ND | 7806 | 209 | 711 | 33 | 23808 |
| | TCN-532 | 2821 | 20 | 2402 | 29 | ND | 78 | 42 | 57 | 2767 | 48 |
| | TCN-504 | 17969 | 17814 | 29988 | 10261 | ND | 8335 | 19600 | 19647 | 36 | 27781 |

TABLE 16-continued

Summary of monoclonal antibody transfection supernatant screening for virus binding to recombinant homotrimeric HA.

|  | | | | | | | | | | | | |
|---|---|---|---|---|---|---|---|---|---|---|---|---|
|  | TCN-523 | 29080 | 640 | 546 | 18903 | ND | 29404 | 3144 | 2017 | 51 | 24193 |
|  | TCN-202 | 63 | 16 | 33 | 14 | ND | 73 | 247 | 66 | 30 | 57 |
|

TABLE 17-continued

Summary of monoclonal antibody transfection supernatant screening for virus neutralization.

| Theraclone mAb ID | BCC well ID | % Neutralization A/Solomon Islands/3/06 H1N1 | A/California/4/09 H1N1 | A/Wisconsin/67/05 H3N2 |
|---|---|---|---|---|
| TCN-523 | 5248_A17 | 39 | 86 | 7 |
| TCN-202 | 2N9 | 0 | 0 | 0 |

Other Embodiments

Although specific embodiments of the invention have been described herein for purposes of illustration, various modifications may be made without deviating from the spirit and scope of the invention. Accordingly, the invention is not limited except as by the appended claims.

While the invention has been described in conjunction with the detailed description thereof, the foregoing description is intended to illustrate and not limit the scope of the invention, which is defined by the scope of the appended claims. Other aspects, advantages, and modifications are within the scope of the following claims.

The patent and scientific literature referred to herein establishes the knowledge that is available to those with skill in the art. All United States patents and published or unpublished United States patent applications cited herein are incorporated by reference. All published foreign patents and patent applications cited herein are hereby incorporated by reference. Genbank and NCBI submissions indicated by accession number cited herein are hereby incorporated by reference. All other published references, documents, manuscripts and scientific literature cited herein are hereby incorporated by reference.

While this invention has been particularly shown and described with references to preferred embodiments thereof, it will be understood by those skilled in the art that various changes in form and details may be made therein without departing from the scope of the invention encompassed by the appended claims.

SEQUENCE LISTING (1345 sequences)

SEQ ID NO: 1 - protein, 24 aa, Influenza A virus
MSLLTEVETPTRNEWGCRCNDSSD

SEQ ID NO: 2 - protein, 24 aa, Influenza A virus
MSLLTEVETPTKNEWECRCNDSSD

SEQ ID NO: 3 - protein, 24 aa, Influenza A virus
MSLLTEVETPIRNEWECRCNDSSD

SEQ ID NO: 4 - protein, 24 aa, Influenza A virus
MSLLTEVETPIRNGWECKCNDSSD

SEQ ID NO: 5 - protein, 24 aa, Influenza A virus
MSLLTEVETPIRSEWGCRCNDSSD

SEQ ID NO: 6 - protein, 24 aa, Influenza A virus
MSFLPEVETPIRNEWGCRCNDSSD

SEQ ID NO: 7 - protein, 24 aa, Influenza A virus
MSLLTEVETPIRNEWGCRCNDSSN

SEQ ID NO: 8 - protein, 24 aa, Influenza A virus
MSLLTEVETPIRKEWGCRCNDSSD

SEQ ID NO: 9 - protein, 24 aa, Influenza A virus
MSFLTEVETPIRNEWGCRCNDSSD

SEQ ID NO: 10 - protein, 24 aa, Influenza A virus
MSLPTEVETPIRSEWGCRCNDSSD

SEQ ID NO: 11 - protein, 24 aa, Influenza A virus
MSLLPEVETPIRNEWGCRCNDSSD

SEQ ID NO: 12 - protein, 24 aa, Influenza A virus
MSLLPEVETPIRNGWGCRCNDSSD

SEQ ID NO: 13 - protein, 24 aa, Influenza A virus
MSLLTEVETPTRNGWECRCSGSSD

SEQ ID NO: 14 - protein, 24 aa, Influenza A virus
MSLLTEVETPIRNEWEYRCNDSSD

SEQ ID NO: 15 - protein, 24 aa, Influenza A virus
MSLLTEVETPIRNEWEYRCSDSSD

SEQ ID NO: 16 - protein, 24 aa, Influenza A virus
MSLLTEVETPTRNGWECRYSDSSD

SEQ ID NO: 17 - protein, 24 aa, Influenza A virus
MSFLTEVETLTRNGWECRCSDSSD

SEQ ID NO: 18 - protein, 24 aa, Influenza A virus
MSLLTEVETLTRNGWECKCRDSSD

SEQ ID NO: 19 - protein, 24 aa, Influenza A virus
MSLLTEVETPIRNEWGCRCNDSSD

SEQ ID NO: 20 - protein, 24 aa, Influenza A virus
MSLLTEVETPIRSEWGCRCNDSGD

SEQ ID NO: 21 - protein, 24 aa, Influenza A virus
MSLLTEVETPIRNEWECRCNGSSD

SEQ ID NO: 22 - protein, 24 aa, Influenza A virus
MSLPTEVETPIRNEWGCRCNDSSD

SEQ ID NO: 23 - protein, 24 aa, Influenza A virus
MSLLTEVETPIRNEWGCRCNGSSD

SEQ ID NO: 24 - protein, 24 aa, Influenza A virus
MSLLTEVDTLTRNGWGCRCSDSSD

SEQ ID NO: 25 - protein, 24 aa, Influenza A virus
MSLLTEVETLTKNGWGCRCSDSSD

SEQ ID NO: 26 - protein, 24 aa, Influenza A virus
MSLLTEVETPTRNGWECKCSDSSD

SEQ ID NO: 27 - protein, 24 aa, Influenza A virus
MSLLTEVETHTRNGWECKCSDSSD

SEQ ID NO: 28 - protein, 24 aa, Influenza A virus
MSLLTEVKTPTRNGWECKCSDSSD

SEQ ID NO: 29 - protein, 24 aa, Influenza A virus
MSLLTEVETLTRNGWGCRCSDSSD

SEQ ID NO: 30 - protein, 24 aa, Influenza A virus
MSLLTEVETPTRDGWECKCSDSSD

SEQ ID NO: 31 - protein, 24 aa, Influenza A virus
MSLLTEVETPTRNGWGCRCSDSSD

SEQ ID NO: 32 - protein, 24 aa, Influenza A virus
MSLLTEVETPTRNGWECKCNDSSD

SEQ ID NO: 33 - protein, 24 aa, Influenza A virus
MSLLTEVETLTRNGWECKCSDSSD

SEQ ID NO: 34 - protein, 24 aa, Influenza A virus
MSLLTEVETPIRNEWGCKCNDSSD

SEQ ID NO: 35 - protein, 24 aa, Influenza A virus
MSFLTEVETPIRNEWGCRCNGSSD

SEQ ID NO: 36 - protein, 24 aa, Influenza A virus
MSLLTEVETPTRNGWECRCNDSSD

SEQ ID NO: 37 - protein, 24 aa, Influenza A virus
MSLLTEVETPIRKGWECNCSDSSD

SEQ ID NO: 38 - protein, 24 aa, Influenza A virus
MSLLTEVETPTRNEWECRCSDSSD

SEQ ID NO: 39 - protein, 24 aa, Influenza A virus
MSLLTGVETHTRNGWGCKCSDSSD

SEQ ID NO: 40 - protein, 24 aa, Influenza A virus
MSLLPEVETHTRNGWGCRCSDSSD

SEQ ID NO: 41 - protein, 8 aa, Influenza A virus
SLLTEVET

SEQ ID NO: 42 - protein, 6 aa, Influenza A virus
SLLTEV

SEQ ID NO: 43 - DNA, 357 bp, Homo sapiens
caggtgcaattgcaggagtcgggcccaggactggtgaagccttcggagaccctgtccctcacctgcactgtctctggttcgtccatcagtaattactactggagctggatccggcagtccccagggaagggactggagtggattgggtttatctattacggtggaaacaccaagtacaatccctccctcaagagccgcgtcaccatatcacaagacacttccaagagtcaggtctccctgacgatgagctctgtgaccgctgcggaatcggccgtctatttctgtgcgagagcgtcttgtagtggtggttactgtatccttgactactggggccagggaaccctggtcaccgtctcg

SEQ ID NO: 44 - protein, 119 aa, Homo sapiens
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVTVS

SEQ ID NO: 45 - DNA, 322 bp, Homo sapiens
gacatccagatgacccagtctccatcctccctgtctgcatctgtaggagacagagtcaccatcacttgccgggcgagtcagaacatttacaagtatttaaattggtatcagcagagaccagggaaagcccctaagggcctgatctctgctgcatccgggttgcaaagtggggtcccatcaaggttcagtggcagtggatctgggacagatttcactctcaccatcaccagtctgcaacctgaagattttgcaacttactactgtcaacagagttacagtccccctctcactttcggcggagggaccagggtggagatcaaac

SEQ ID NO: 46 - protein, 107 aa, Homo sapiens
DIQMTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVEIK

SEQ ID NO: 47 - DNA, 357 bp, Homo sapiens; identical to SEQ ID NO: 43

SEQ ID NO: 48 - DNA, 322 bp, Homo sapiens
gacatccaggtgacccagtctccatcctccctgtctgcatctgtaggagacagagtcaccatcacttgccgcgcgagtcagaacatttacaagtatttaaattggtatcagcagagaccagggaaagcccctaagggcctgatctctgctgcatccgggttgcaaagtggggtcccatcaaggttcagtggcagtggatctgggacagatttcactctcaccatcaccagtctgcaacctgaagattttgcaacttactactgtcaacagagttacagtccccctctcactttcggcggagggaccagggtggatatcaaac

SEQ ID NO: 49 - DNA, 357 bp, Homo sapiens
gaggtgcagctggtggagtctgggggaggcttggtccagcctggggggtccctgagaatctcctgtgcagcctctggattcaccgtcagtagcaactacatgagttgggtccgccaggctccagggaaggggctggagtgggtctcagttatttatagtggtggtagcacatactacgcagactccgtgaagggcagattctccttctccagagacaactccaagaacacagtgtttcttcaaatgaacagcctgagagccgaggacacggctgtgtattactgtgcgagatgtctgagcaggatgcggggttacggtttagacgtctggggccaagggaccacggtcaccgtctcg

SEQ ID NO: 50 - protein, 119 aa, Homo sapiens
EVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQGTTVTVS

SEQ ID NO: 51 - DNA, 318 bp, Homo sapiens
gacatccagatgacccagtctccatcctccctgtctgcatctgtaggagacagagtcaccatcacttgccggacaagtcagagcattagcagctatttaaattggtatcagcagaaaccagggaaagcccctaaactcctgatctatgctgcatccagtttgcaaagtggggtcccatcaaggttcagtggcagtggatctgggacagatttcactctcaccatcagcggtctgcaacctgaagattttgcaacctactactgtcaacagagttacagtatgcctgcctttggccaggggaccaagctggagatcaaa

SEQ ID NO: 52 - protein, 106 aa, Homo sapiens
DIQMTQSPSSLSASVGDRVTITCRTSQSISSYLNWYQQKPGKAPKLLIYAASSLQSGVPSRFSGSGSGTDFTLTISGLQPEDFATYYCQQSYSMPAFGQGTKLEIK

SEQ ID NO: 53 - DNA, 291 bp, Influenza A virus
atgagtcttctaaccgaggtcgaaacgcctatcagaaacgaatgggggtgcagatgcaacgattcaagtgatcctcttgttgttgccgcaagtatcattgggatcctgcacttgatattgtggattcttgatcgtctttttttcaaatgcatttatcgtctctttaaacacggtctgaaaagagggccttctacggaaggagtaccagagtctatgagggaagaatatcgaaaggaacagcagagtgctgtggatgctgacgatagtcattttgtcaacatagagctggag

SEQ ID NO: 54 - DNA, 404 bp, Homo sapiens
aagcttccaccatggacatgagggtcctcgctcagctcctggggctcctgctactctggctccgaggtgccagatgtgacatccagatgacccagtctccatcctccctgtctgcatctgtaggagacagagtcaccatcacttgccgggcgagtcagaacatttacaagtatttaaattggtatcagcagagaccagggaaagcccctaagggcctgatctctgctgcatccgggttgcaaagtggggtcccatcaaggttcagtggcagtggatctgggacagatttcactctcaccatcaccagtctgcaacctgaagattttgcaacttactactgtcaacagagttacagtccccctctcactttcggcggagggaccagggtggagatcaaacgtacg

SEQ ID NO: 55 - DNA, 404 bp, Homo sapiens
cgtacgtttgatctccaccctggtccctccgccgaaagtgagagggggactgtaactctgttgacagtagtaagttgcaaaatcttcaggttgcagactggtgatggtgagagtgaaatctgtcccagatccactgccactgaaccttgatgggaccccactttgcaacccggatgcagcagagatcaggcccttaggggctttccctggtctctgctgataccaatttaaatacttgtaaatgttctgactcgcccggcaagtgatggtgactctgtctcctacagatgcagacagggaggatggagactgggtcatctggatgtcacatctggcacctcggagccagagtagcaggagccccaggagctgagcgaggaccctcatgtccatggtggaagctt

SEQ ID NO: 56 - protein, 236 aa, Homo sapiens
MDMRVLAQLLGLLLLWLRGARCDIQMTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 57 - protein, 22 aa, Homo sapiens
MDMRVLAQLLGLLLLWLRGARC

SEQ ID NO: 58 - protein, 23 aa, Homo sapiens
DIQMTQSPSSLSASVGDRVTITC

SEQ ID NO: 59 - protein, 11 aa, Homo sapiens
RASQNIYKYLN

SEQ ID NO: 60 - protein, 15 aa, Homo sapiens
WYQQRPGKAPKGLIS

SEQ ID NO: 61 - protein, 7 aa, Homo sapiens
AASGLQS

SEQ ID NO: 62 - protein, 32 aa, Homo sapiens
GVPSRFSGSGSGTDFTLTITSLQPEDFATYYC

SEQ ID NO: 63 - protein, 9 aa, Homo sapiens
QQSYSPPLT

SEQ ID NO: 64 - protein, 10 aa, Homo sapiens
FGGGTRVEIK

SEQ ID NO: 65 - DNA, 800 bp, Artificial Sequence
  Recombinant human sequence
tcgaaattaatacgactcactatagggagacccaagctggctagcgtttaaacttaagcttccaccatggacatgagggtcctcgctcagctcctggggctcctgctactctggctccgaggtgccagatgtgacatccagatgacccagtctccatcctccctgtctgcatctgtaggagacagagtcaccatcacttgccgggcgagtcagaacatttacaagtatttaaattggtatcagcagagaccagggaaagcccctaagggcctgatctctgctgcatccgggttgcaaagtggggtcccatcaaggttcagtggcagtggatctgggacagatttcactctcaccatcaccagtctgcaacctgaagattttgcaacttactactgtcaacagagttacagtccccctctcactttcggcggagggaccagggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggtctagagggcccgtttaaa

SEQ ID NO: 66 - DNA, 800 bp, Artificial Sequence
  Recombinant Human sequence
tttaaacgggccctctagaccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccaccgtacgtttgatctccaccctggtccctccgccgaaagtgagagggggactgtaactctgttgacagtagtaagttgcaaaatcttcaggttgcagactggtgatggtgagagtgaaatctgtcccagatccactgccactgaaccttgatgggaccccactttgcaacccggatgcagcagagatcaggcccttaggggctttccctggtctctgctgataccaatttaaatacttgtaaatgttctgactcgcccggcaagtgatggtgactctgtctcctacagatgcagacagggaggatggagactgggtcatctggatgtcacatctggcacctcggagccagagtagcaggagccccaggagctgagcgaggaccctcatgtccatggtggaagcttaagtttaaacgctagccagcttgggtctccctatagtgagtcgtattaatttcga

SEQ ID NO: 67 - DNA, 427 bp, Homo sapiens
aagcttccaccatgaaacacctgtggttcttccttctcctggtggcagctcccagctgggtcctgtcccaggtgcaattgcaggagtcgggcccaggactggtgaagccttcggagaccctgtccctcacctgcactgtctctggttcgtccatcagtaattactactggagctggatccggcagtccccagggaagggactggagtggattgggtttatctattacggtggaaacaccaagtacaatccctccctcaagagccgcgtcaccatatcacaagacacttccaagagtcaggtctccctgacgatgagctctgtgaccgctgcggaatcggccgtctatttctgtgcgagagcgtcttgtagtggtggttactgtatccttgactactggggccagggaaccctggtcaccgtctcgag

SEQ ID NO: 68 - DNA, 427 bp, Homo sapiens
ctcgagacggtgaccagggttccctggccccagtagtcaaggatacagtaaccaccactacaagacgctctcgcacagaaatagacggccgattccgcagcggtcacagagctcatcgtcagggagacctgactcttggaagtgtcttgtgatatggtgacgcggctcttgagggagggattgtacttggtgtttccaccgtaatagataaacccaatccactccagtcccttccctggggactgccggatccagctccagtagtaattactgatggacgaaccagagacagtgcaggtgagggacagggtctccgaaggcttcaccagtcctgggcccgactcctgcaattgcacctgggacaggacccagctgggagctgccaccaggagaaggaagaaccacaggtgtttcatggtggaagctt

SEQ ID NO: 69 - protein, 469 aa, Homo sapiens [sequence omitted]

SEQ ID NO: 70 - protein, 19 aa, Homo sapiens
MKHLWFFLLLVAAPSWVLS

SEQ ID NO: 71 - protein, 30 aa, Homo sapiens
QVQLQESGPGLVKPSETLSLTCTVSGSSIS

SEQ ID NO: 72 - protein, 5 aa, Homo sapiens
NYYWS

SEQ ID NO: 73 - protein, 14 aa, Homo sapiens
WIRQSPGKGLEWIG

SEQ ID NO: 74 - protein, 16 aa, Homo sapiens
FIYYGGNTKYNPSLKS

SEQ ID NO: 75 - protein, 32 aa, Homo sapiens
RVTISQDTSKSQVSLTMSSVTAAESAVYFCAR

SEQ ID NO: 76 - protein, 11 aa, Homo sapiens
ASCSGGYCILD

SEQ ID NO: 77 - protein, 11 aa, Homo sapiens
YWGQGTLVTVS

SEQ ID NO: 78 - DNA, 1557 bp, Artificial Sequence
  Recombinant Human Sequence
tggcttatcgaaattaatacgactcactatagggagacccaagctggctagcgtttaaacttaagcttccaccatgaaacacctgtggttcttccttctcctggtggcagctcccagctgggtcctgtcccaggtgcaattgcaggagtcgggcccaggactggtgaagccttcggagaccctgtccctcacctgcactgtctctggttcgtccatcagtaattactactggagctggatccggcagtccccagggaagggactggagtggattgggtttatctattacggtggaaacaccaagtacaatccctccctcaagagccgcgtcaccatatcacaagacacttccaagagtcaggtctccctgacgatgagctctgtgaccgctgcggaatcggccgtctatttctgtgcgagagcgtcttgtagtggtggttactgtatccttgactactggggccagggaaccctggtcaccgtctcgagagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatgagttctagagggcccgtttaaacccgctgatcagcctcgactgtgccttctagttgccagccatctgttgtttgc

SEQ ID NO: 79 - DNA, 1557 bp, Artificial Sequence
  Recombinant  Human Sequence
gcaaacaacagatggctggcaactagaaggcacagtcgaggctgatcagcgggtttaaacgggccctctagaactcatttacccggagacagggagaggctcttctgcgtgtagtggttgtgcagagcctcatgcatcacggagcatgagaagacgttcccctgctgccacctgctcttgtccacggtgagcttgctatagaggaagaaggagccgtcggagtccagcacgggaggcgtggtcttgtagttgttctccggctgcccattgctctcccactccacggcgatgtcgctgggatagaagcctttgaccaggcaggtcaggctgacctggttcttggtcatctcctcccgggatgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtccccccaggagttcaggtgctgggcacggtgggcatgtgtgagttttgtcacaagatttgggctcaactctcttgtccaccttggtgttgctgggcttgtgattcacgttgcagatgtaggtctgggtgcccaagctgctggagggcacggtcaccacgctgctgagggagtagagtcctgaggactgtaggacagccgggaaggtgtgcacgccgctggtcagggcgcctgagttccacgacaccgtcaccggttcggggaagtagtccttgaccaggcagcccagggccgctgtgcccccagaggtgctcttggaggagggtgccagggggaagaccgatgggcccttggtggaggctctcgagacggtgaccagggttccctggccccagtagtcaaggatacagtaaccaccactacaagacgctctcgcacagaaatagacggccgattccgcagcggtcacagagctcatcgtcagggagacctgactcttggaagtgtcttgtgatatggtgacgcggctcttgagggagggattgtacttggtgtttccaccgtaatagataaacccaatccactccagtcccttccctggggactgccggatccagctccagtagtaattactgatggacgaaccagagacagtgcaggtgagggacagggtctccgaaggcttcaccagtcctgggcccgactcctgcaattgcacctgggacaggacccagctgggagctgccaccaggagaaggaagaaccacaggtgtttcatggtggaagcttaagtttaaacgctagccagcttgggtctccctatagtgagtcgtattaatttcgataagcca

SEQ ID NO: 80 - protein, 11 aa, Homo sapiens
WGQGTLVTVSS

SEQ ID NO: 81 - DNA, 6 bp, Artificial Sequence
  Restriction site
ctcgag

SEQ ID NO: 82 - protein, 11 aa, Homo sapiens
WGQGTLVTVSR

SEQ ID NO: 83 - DNA, 404 bp, Homo sapiens
aagcttccaccatggacatgagggtcctcgctcagctcctggggctcctgctactctggctccgaggtgccagatgtgacatccaggtgacccagtctccatcctccctgtctgcatctgtaggagacagagtcaccatcacttgccgcgcgagtcagaacatttacaagtatttaaattggtatcagcagagaccagggaaagcccctaagggcctgatctctgctgcatccgggttgcaaagtggggtcccatcaaggttcagtggcagtggatctgggacagatttcactctcaccatcaccagtctgcaacctgaagattttgcaacttactactgtcaacagagttacagtccccctctcactttcggcggagggaccagggtggatatcaaacgtacg

SEQ ID NO: 84 - DNA, 404 bp, Homo sapiens
cgtacgtttgatatccaccctggtccctccgccgaaagtgagagggggactgtaactctgttgacagtagtaagttgcaaaatcttcaggttgcagactggtgatggtgagagtgaaatctgtcccagatccactgccactgaaccttgatgggaccccactttgcaacccggatgcagcagagatcaggcccttaggggctttccctggtctctgctgataccaatttaaatacttgtaaatgttctgactcgcgcggcaagtgatggtgactctgtctcctacagatgcagacagggaggatggagactgggtcacctggatgtcacatctggcacctcggagccagagtagcaggagccccaggagctgagcgaggaccctcatgtccatggtggaagctt

SEQ ID NO: 85 - DNA, 427 bp, Homo sapiens; identical to SEQ ID NO: 67

SEQ ID NO: 86 - DNA, 427 bp, Homo sapiens; identical to SEQ ID NO: 68

SEQ ID NO: 87 - DNA, 427 bp, Homo sapiens; identical to SEQ ID NO: 67

SEQ ID NO: 88 - DNA, 401 bp, Homo sapiens
aagcttccaccatggacatgagggtcctcgctcagctcctggggctcctgctactctggctccgaggtgccagatgtgacatccagatgacccagtctccatcctccctgtctgcatctgtaggagacagagtcaccatcacttgccggacaagtcagagcattagcagctatttaaattggtatcagcagaaaccagggaaagcccctaaactcctgatctatgctgcatccagtttgcaaagtggggtcccatcaaggttcagtggcagtggatctgggacagatttcactctcaccatcagcggtctgcaacctgaagattttgcaacctactactgtcaacagagttacagtatgcctgcctttggccaggggaccaagctggagatcaaacgtacg

SEQ ID NO: 89 - DNA, 401 bp, Homo sapiens
cgtacgtttgatctccagcttggtcccctggccaaaggcaggcatactgtaactctgttgacagtagtaggttgcaaaatcttcaggttgcagaccgctgatggtgagagtgaaatctgtcccagatccactgccactgaaccttgatgggaccccactttgcaaactggatgcagcatagatcaggagtttaggggctttccctggtttctgctgataccaatttaaatagctgctaatgctctgacttgtccggcaagtgatggtgactctgtctcctacagatgcagacagggaggatggagactgggtcatctggatgtcacatctggcacctcggagccagagtagcaggagccccaggagctgagcgaggaccctcatgtccatggtggaagctt

SEQ ID NO: 90 - DNA, 401 bp, Homo sapiens; identical to SEQ ID NO: 88

SEQ ID NO: 91 - protein, 130 aa, Homo sapiens
MDMRVLAQLLGLLLLWLRGARCDIQMTQSPSSLSASVGDRVTITCRTSQSISSYLNWYQQKPGKAPKLLIYAASSLQSGVPSRFSGSGSGTDFTLTISGLQPEDFATYYCQQSYSMPAFGQGTKLEIKRT

SEQ ID NO: 92 - protein, 11 aa, Homo sapiens
RTSQSISSYLN

SEQ ID NO: 93 - protein, 15 aa, Homo sapiens
WYQQKPGKAPKLLIY

SEQ ID NO: 94 - protein, 13 aa, Homo sapiens
AASSLQSGVPSRF

SEQ ID NO: 95 - protein, 26 aa, Homo sapiens
SGSGSGTDFTLTISGLQPEDFATYYC

SEQ ID NO: 96 - protein, 8 aa, Homo sapiens
QQSYSMPA

SEQ ID NO: 97 - DNA, 427 bp, Homo sapiens
aagcttccaccatggagttggggctgtgctgggttttccttgttgctattttaaaaggtgtccagtgtgaggtgcagctggtggagtctgggggaggcttggtccagcctggggggtccctgagaatctcctgtgcagcctctggattcaccgtcagtagcaactacatgagttgggtccgccaggctccagggaaggggctggagtgggtctcagttatttatagtggtggtagcacatactacgcagactccgtgaagggcagattctccttctccagagacaactccaagaacacagtgtttcttcaaatgaacagcctgagagccgaggacacggctgtgtattactgtgcgagatgtctgagcaggatgcggggttacggtttagacgtctggggccaagggaccacggtcaccgtctcgag

SEQ ID NO: 98 - DNA, 427 bp, Homo sapiens
ctcgagacggtgaccgtggtcccttggccccagacgtctaaaccgtaaccccgcatcctgctcagacatctcgcacagtaatacacagccgtgtcctcggctctcaggctgttcatttgaagaaacactgtgttcttggagttgtctctggagaaggagaatctgcccttcacggagtctgcgtagtatgtgctaccaccactataaataactgagacccactccagccccttccctggagcctggcggacccaactcatgtagttgctactgacggtgaatccagaggctgcacaggagattctcagggaccccccaggctggaccaagcctcccccagactccaccagctgcacctcacactggacaccttttaaaatagcaacaaggaaaacccagcacagccccaactccatggtggaagctt

SEQ ID NO: 99 - DNA, 427 bp, Homo sapiens; identical to SEQ ID NO: 97

SEQ ID NO: 100 - protein, 138 aa, Homo sapiens
MELGLCWVFLVAILKGVQCEVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQGTTVTVS

SEQ ID NO: 101 - protein, 19 aa, Homo sapiens
MELGLCWVFLVAILKGVQC

SEQ ID NO: 102 - protein, 30 aa, Homo sapiens
EVQLVESGGGLVQPGGSLRISCAASGFTVS

SEQ ID NO: 103 - protein, 5 aa, Homo sapiens
SNYMS

SEQ ID NO: 104 - protein, 14 aa, Homo sapiens
WVRQAPGKGLEWVS

SEQ ID NO: 105 - protein, 15 aa, Homo sapiens
VIYSGGSTYYADSVK

SEQ ID NO: 106 - protein, 33 aa, Homo sapiens
GRFSFSRDNSKNTVFLQMNSLRAEDTAVYYCAR

SEQ ID NO: 107 - protein, 12 aa, Homo sapiens
CLSRMRGYGLDV

SEQ ID NO: 108 - protein, 10 aa, Homo sapiens
WGQGTTVTVS

SEQ ID NO: 109 - protein, 6 aa, Homo sapiens
GSSISN

SEQ ID NO: 110 - protein, 9 aa, Homo sapiens
FIYYGGNTK

SEQ ID NO: 111 - protein, 11 aa, Homo sapiens
WGQGTTVTVSS

SEQ ID NO: 112 - protein, 7 aa, Homo sapiens
GFTVSSN

SEQ ID NO: 113 - protein, 9 aa, Homo sapiens
VIYSGGSTY

SEQ ID NO: 114 - protein, 10 aa, Homo sapiens
FGQGTKLEIK

SEQ ID NO: 115 - DNA, 366 bp, Homo sapiens
caggtgcagctgcagcagtcgggcccaggactggtgaagccttcacagaccctgtccctcacttgcactgtctctggtggccccgtcagcggtggtggttactcctggaactggatccgccaacgcccaggacagggcctggagtgggttgggttcatgtttcacagtgggagtccccgctacaatccgaccctcaagagtcgaattaccatctcagtcgacacgtctaagaacctggtctccctgaagctgagctctgtgacggccgcggacacggccgtgtatttttgtgcgcgagtggggcagatggacaagtactatgccatggacgtctggggccaagggaccacggtcaccgtctcgagc

SEQ ID NO: 116 - protein, 122 aa, Homo sapiens
QVQLQQSGPGLVKPSQTLSLTCTVSGGPVSGGGYSWNWIRQRPGQGLEWVGFMFHSGSPRYNPTLKSRITISVDTSKNLVSLKLSSVTAADTAVYFCARVGQMDKYYAMDVWGQGTTVTVSS

SEQ ID NO: 117 - DNA, 323 bp, Homo sapiens
gacatccagatgacccagtctccatcctccctgtcttcctctgtcggagacagagtcaccatcacttgccgggcaagtcagagcattggcgcctatgtaaattggtatcaacagaaagcagggaaagccccccaggtcctgatctttggtgcttccaatttacaaagcggggtcccatcaaggttcagtggcagtggatctgggacagatttcactctcaccatcagcagtctgcaacctgaagactttgcaacttacttctgtcaacagacttacagtaccccgatcaccttcggccaagggacacgactggagattaaacg

SEQ ID NO: 118 - protein, 107 aa, Homo sapiens
DIQMTQSPSSLSSSVGDRVTITCRASQSIGAYVNWYQQKAGKAPQVLIFGASNLQSGVPSRFSGSGSGTDFTLTISSLQPEDFATYFCQQTYSTPITFGQGTRLEIK

SEQ ID NO: 119 - DNA, 363 bp, Homo sapiens
caggtccagctgcaggagtcgggcccaggactgctgaagccttcggacaccctggccctcacttgcactgtctctggtggctccatcaccagtgactactggagctggatccggcaacccccagggaggggactggactggatcggattcttctataacggcggaagcaccaagtacaatccctccctcaagagtcgagtcaccatttcagcggacacgtccaagaaccagttgtccctgaaattgacctctgtgaccgccgcagacacgggcgtgtattattgtgcgagacatgatgccaaatttagtgggagctactacgttgcctcctggggccagggaacccgagtcaccgtctcgagc

SEQ ID NO: 120 - protein, 121 aa, Homo sapiens
QVQLQESGPGLLKPSDTLALTCTVSGGSITSDYWSWIRQPPGRGLDWIGFFYNGGSTKYNPSLKSRVTISADTSKNQLSLKLTSVTAADTGVYYCARHDAKFSGSYYVASWGQGTRVTVSS

SEQ ID NO: 121 - DNA, 323 bp, Homo sapiens
gacatccagatgacccagtctccatcctccctgtctgcatctgtaggagacagagtcaccatctcttgccgggcaagtcagagcattagcacctatttaaattggtatcagcagcaacctgggaaagcccctaaggtcctcatttttggtgcaaccaacttgcaaagtggggtcccatctcgcttcagtggcagtggatctgggacagatttcactctcaccatcagcagtctgcaacctgaagattttgcaacttactactgtcaacagagttacaatacccccctcatttttggccaggggaccaagctggagatcaaacg

SEQ ID NO: 122 - protein, 107 aa, Homo sapiens
DIQMTQSPSSLSASVGDRVTISCRASQSISTYLNWYQQQPGKAPKVLIFGATNLQSGVPSRFSGSGSGTDFTLTISSLQPEDFATYYCQQSYNTPLIFGQGTKLEIK

SEQ ID NO: 123 - DNA, 363 bp, Homo sapiens
caggtccagctgcaggagtcgggcccaggactgctgaagccttcggacaccctggccctcacttgcactgtctctggtggctccatcaccagtgactactggagctggatccggcaacccccagggaggggactggactggatcggattcttctataacggcgggagcaccaagtacaatccctccctcaagagtcgagtcaccatatcagcggacacgtccaagaaccagttgtccctgaaattgacctctgtgaccgccgcagacacgggcgtgtattattgtgcgagacatgatgtcaaatttagtgggagctactacgttgcctcctggggccagggaacccgagtcaccgtctcgagc

SEQ ID NO: 124 - protein, 121 aa, Homo sapiens
QVQLQESGPGLLKPSDTLALTCTVSGGSITSDYWSWIRQPPGRGLDWIGFFYNGGSTKYNPSLKSRVTISADTSKNQLSLKLTSVTAADTGVYYCARHDVKFSGSYYVASWGQGTRVTVSS

SEQ ID NO: 125 - DNA, 323 bp, Homo sapiens
gacatccagatgacccagtctccatcctccctgtctgcatctgtaggagacagagtcaccatctcttgccgggcaagtcagagcattagcacctatttaaattggtatcagcagcaacctgggaaagcccctaaggtcctgatctctggtgcaaccaacttgcaaagtggggtcccatctcgcttcagtggcagtggatctgggacagatttcactctcaccatcagcagtctgcaacctgaagattttgcaacttactactgtcaacagagttacaatacccccctcatttttggccaggggaccaagctggagatcaaacg

SEQ ID NO: 126 - protein, 107 aa, Homo sapiens
DIQMTQSPSSLSASVGDRVTISCRASQSISTYLNWYQQQPGKAPKVLISGATNLQSGVPSRFSGSGSGTDFTLTISSLQPEDFATYYCQQSYNTPLIFGQGTKLEIK

SEQ ID NO: 127 - DNA, 360 bp, Homo sapiens
caggtgcagctgcaggagtcgggcccacgagtggtgaggccttcggagaccctgtccctcacctgcactgtctcggggggctccatcagttcttacaactggatttggatccggcagccccctgggaagggactggagtggattgggcacatatatgactatgggaggaccttctacaactcctccctccagagtcgacctaccatatctgtagacgcgtccaagaatcagctctccctgcgattgacctctgtgaccgcctcagacacggccgtctattactgtgcgagacctctcggtatactccactactacgcgatggacctctggggccaagggaccacggtcaccgtctcgagc

SEQ ID NO: 128 - protein, 120 aa, Homo sapiens
QVQLQESGPRVVRPSETLSLTCTVSGGSISSYNWIWIRQPPGKGLEWIGHIYDYGRTFYNSSLQSRPTISVDASKNQLSLRLTSVTASDTAVYYCARPLGILHYYAMDLWGQGTTVTVSS

SEQ ID NO: 129 - DNA, 320 bp, Homo sapiens
gacatccagatgacccagtctccattatccgtgtctgtatctgtcggggacagggtcaccatcgcttgccgggcaagtcagagtattgacaagtttttaaattggtatcagcagaaaccagggaaagcccctaaactcctgatctatggtgcctccaatttgcacagtggggccccatcaaggttcagtgccagtgggtctgggacagacttcactctaacaatcaccaatatacagactgaagatttcgcaacttacctctgtcaacagagtttcagtgtccccgctttcggcggagggaccaaggttgagatcaaacg

SEQ ID NO: 130 - protein, 106 aa, Homo sapiens
DIQMTQSPLSVSVSVGDRVTIACRASQSIDKFLNWYQQKPGKAPKLLIYGASNLHSGAPSRFSASGSGTDFTLTITNIQTEDFATYLCQQSFSVPAFGGGTKVEIK

SEQ ID NO: 131 - DNA, 354 bp, Homo sapiens
gaggtgcaactggtggagtctggagggggcttggtccagcctggggggtccctgagactctcctgtacggcctctgggttaagtgtcagttccacctacatgaactgggtccgccaggctccagggaaggggctggaatgggtctcagttttttatagtgagaccaggacgtactacgcagactccgtgaagggccgattcaccgtctccagacacaattccaacaacacgctctatcttcagatgaacagcctgagagttgaagacacggccgtgtattattgtgcgagagtccagagattgtcgtacggtatggacgtctggggccaagggaccacggtcaccgtctcgagc

SEQ ID NO: 132 - protein, 118 aa, Homo sapiens
EVQLVESGGGLVQPGGSLRLSCTASGLSVSSTYMNWVRQAPGKGLEWVSVFYSETRTYYADSVKGRFTVSRHNSNNTLYLQMNSLRVEDTAVYYCARVQRLSYGMDVWGQGTTVTVSS

SEQ ID NO: 133 - DNA, 320 bp, Homo sapiens
gacatccagatgacccagtctccatcctccctgtctgcatctgttggagacagagtcaccatcacttgccgggcaagtcagagcattagcacctatttaaattggtatcagaagagaccagggaaagcccctaaactcctggtctatggtgcatccactttgcagagtggggtcccatcaaggttcagtggcagtggatctgggacagatttcactctcaccatcgccagtctgcaacctgaagattctgcaacttactactgtcaacagacttacagtatccccctcttcggccaggggacacggctggagattaaacg

SEQ ID NO: 134 - protein, 106 aa, Homo sapiens
DIQMTQSPSSLSASVGDRVTITCRASQSISTYLNWYQKRPGKAPKLLVYGASTLQSGVPSRFSGSGSGTDFTLTIASLQPEDSATYYCQQTYSIPLFGQGTRLEIK

SEQ ID NO: 135 - DNA, 354 bp, Homo sapiens
gaggtgcagctggtggaatctggagggggcttggtccagcctggggggtccctgagactctcctgtacagcctctgggttaagcgtcagttccacctacatgaactgggtccgccaggctccagggaaggggctggaatgggtctcagttttttatagtgaaaccaggacgtattacgcagactccgtgaagggccgattcaccgtctccagacacaattccaacaacacgctgtatcttcaaatgaacagcctgagagctgaagacacggccgtgtattattgtgcgagagtccagagactgtcatacggtatggacgtctggggccaagggaccacggtcaccgtctcgagc

SEQ ID NO: 136 - protein, 118 aa, Homo sapiens
EVQLVESGGGLVQPGGSLRLSCTASGLSVSSTYMNWVRQAPGKGLEWVSVFYSETRTYYADSVKGRFTVSRHNSNNTLYLQMNSLRAEDTAVYYCARVQRLSYGMDVWGQGTTVTVSS

SEQ ID NO: 137 - DNA, 320 bp, Homo sapiens
gacatccagatgacccagtctccatcgtccctgtctgcatctgtaggagacagagtcaccatcacttgccgggcaagtcagagcattagcacctatttaaattggtatcagaagagaccagggaaagcccctaaactcctggtctatggtgcatccagtttgcagagtggggtcccatcaaggttcagtggcagtggatctgggacagatttcactctcaccatcgccagtctgcaacctgaagattctgcagtttattactgtcaacagacttacagtatccccctcttcggccaggggacacgactggagattaaacg

SEQ ID NO: 138 - protein, 106 aa, Homo sapiens
DIQMTQSPSSLSASVGDRVTITCRASQSISTYLNWYQKRPGKAPKLLVYGASSLQSGVPSRFSGSGSGTDFTLTIASLQPEDSAVYYCQQTYSIPLFGQGTRLEIK

SEQ ID NO: 139 - DNA, 360 bp, Homo sapiens
caggtgcagctgcaggagtcgggcccaggactggtgaagccctcggagaccctgtccctcacctgcagtgtctctggtggctccattagtagtgatttctggagttggatccgacagcccccagggaagggactggagtggattgggtatgtctataacagagggagcactaagtacagtccctccctcaagagtcgagtcaccatatcagcagacatgtccaagaaccagttttccctgaatatgagttctgtgaccgctgcggacacggccgtgtattactgtgcgaaaaatggtcgaagtagcaccagttggggcatcgacgtctggggcaaagggaccacggtcaccgtctcgagc

SEQ ID NO: 140 - protein, 120 aa, Homo sapiens
QVQLQESGPGLVKPSETLSLTCSVSGGSISSDFWSWIRQPPGKGLEWIGYVYNRGSTKYSPSLKSRVTISADMSKNQFSLNMSSVTAADTAVYYCAKNGRSSTSWGIDVWGKGTTVTVSS

SEQ ID NO: 141 - DNA, 323 bp, Homo sapiens
gacatccagatgacccagtctccatcctccctgtctgcatctgtgggagacagactcaccatcacttgccgggcaagtcagagcattagcacctatttacattggtatcagcagaaaccagggaaagcccctaaactcctgatctatgctgcatccagtttgcaaagtggggtcccatcaaggttcagtggcagtagatcaggaacagatttcactctcaccatcagcagtctgcaacctgatgactttgcaacttactactgtcaacagagttacagtccccccctcactttcggccctgggaccaaagtggatatgaaacg

SEQ ID NO: 142 - protein, 107 aa, Homo sapiens
DIQMTQSPSSLSASVGDRLTITCRASQSISTYLHWYQQKPGKAPKLLIYAASSLQSGVPSRFSGSRSGTDFTLTISSLQPDDFATYYCQQSYSPPLTFGPGTKVDMK

SEQ ID NO: 143 - DNA, 357 bp, Homo sapiens
caggtgcagctgcaggagtcgggcccaggactggtgaagccttcggagaccctgtccctcacctgcactgtctctggtgcctccatcagtagtgactactggagctggatccggctgcccccagggaagggactggagtggattgggtatatctataatagagggagtaccaagtacaccccctccctgaagagtcgagtcaccatatcactagacacggccgagaaccagttctccctgaggctgaggtcggtgaccgccgcagacacggccatctattactgtgcgagacatgtaggtggccacacctatggaattgattactggggccagggaaccctggtcaccgtctcgagc

SEQ ID NO: 144 - protein, 119 aa, Homo sapiens
QVQLQESGPGLVKPSETLSLTCTVSGASISSDYWSWIRLPPGKGLEWIGYIYNRGSTKYTPSLKSRVTISLDTAENQFSLRLRSVTAADTAIYYCARHVGGHTYGIDYWGQGTLVTVSS

SEQ ID NO: 145 - DNA, 323 bp, Homo sapiens
gacatccagatgacccagtctccatcgtccctgtctgcctctgtaggagacagagtcaccatcacttgccgggcaagtcagagcattagcaactatttaaattggtatcaacacaaacctggggaagcccccaagctcctgaactatgctgcgtccagtttgcaaagtggggtcccatcaaggttcagtgccagtggatctgggacagatttcactctcaccatcagcagtcttcaacctgaagattttgccacttactactgtcaacagagttacaatactccgatcaccttcggccaagggacacgactggaaattaaacg

SEQ ID NO: 146 - protein, 107 aa, Homo sapiens
DIQMTQSPSSLSASVGDRVTITCRASQSISNYLNWYQHKPGEAPKLLNYAASSLQSGVPSRFSASGSGTDFTLTISSLQPEDFATYYCQQSYNTPITFGQGTRLEIK

SEQ ID NO: 147 - DNA, 357 bp, Homo sapiens
caggtgcagctgcaggagtcgggcccaggactggtgaagccttcggagaccctgtccctcacctgcactgtctctggtgcctccatcagtagtgactactggagctggatccggctgcccccagggaagggactggagtggattgggtatatctataatagagggagtaccaagtacaccccctccctgaagagtcgagtcaccatatcactagacacggccgagaaccagttctccctgaggctgaggtcggtgaccgccgcagacacggccgtctattactgtgcgagacatgtgggtggccacacctatggaattgattactggggccagggaaccctggtcaccgtctcgagc

SEQ ID NO: 148 - protein, 119 aa, Homo sapiens
QVQLQESGPGLVKPSETLSLTCTVSGASISSDYWSWIRLPPGKGLEWIGYIYNRGSTKYTPSLKSRVTISLDTAENQFSLRLRSVTAADTAVYYCARHVGGHTYGIDYWGQGTLVTVSS

SEQ ID NO: 149 - DNA, 323 bp, Homo sapiens
gacatccagatgacccagtctccatcgtccctgtctgcctctgtaggagacagagtcaccatcacttgccgggcaagtcagagcattagcaactatttaaattggtatcaacacaaacctggggaagcccccaagctcctgaactatgctgcgtccagtttgcaaagtggggtcccatcaaggttcagtgccagtggatctgggacagatttcactctcagcatcagcggtcttcaacctgaagattttgccacttactactgtcaacagagctacaatactccgatcaccttcggcccagggacacgactggaaattaaacg

SEQ ID NO: 150 - protein, 107 aa, Homo sapiens
DIQMTQSPSSLSASVGDRVTITCRASQSISNYLNWYQHKPGEAPKLLNYAASSLQSGVPSRFSASGSGTDFTLSISGLQPEDFATYYCQQSYNTPITFGPGTRLEIK

SEQ ID NO: 151 - DNA, 363 bp, Homo sapiens
caggtgcagctgcaggagtcgggcccaggactggtgaagccttcggagaccctgtccgtcacctgcaaagtctctggtgactccatcagtagttattcctggagctggatccggcagcccccagggaagggactggagtgggttggctatttgtattatagtgggagcaccaagtacaacccctccctcaagagtcgaaccaccatatcagtagacacgtccacgaaccagttgtccctgaagttgagttttgtgaccgccgcggacacggccgtgtatttctgtgcgagaaccggctcggaatctactaccggctacggtatggacgtctggggccaagggaccacggtcaccgtctcgagc

SEQ ID NO: 152 - protein, 121 aa, Homo sapiens
QVQLQESGPGLVKPSETLSVTCKVSGDSISSYSWSWIRQPPGKGLEWVGYLYYSGSTKYNPSLKSRTTISVDTSTNQLSLKLSFVTAADTAVYFCARTGSESTTGYGMDVWGQGTTVTVSS

SEQ ID NO: 153 - DNA, 323 bp, Homo sapiens
gacatccagatgacccagtctccatcctccctgtctgcatctgtaggagacagagtcaccatcacttgccgggcaagtcagagcattagcacctatttaaattggtatcagcagaaaccagggaaagcccctaagctcctgatctatgctgcatccagtttgcacagtggggtcccatcaaggttcagtggcagtggatctgggacagatttcgctctcaccatcagcagtctgcaacctgaagattttgcaacttactactgtcaacagagttacagtcccccgatcaccttcggccaagggacacgactggagattaaacg

SEQ ID NO: 154 - protein, 107 aa, Homo sapiens
DIQMTQSPSSLSASVGDRVTITCRASQSISTYLNWYQQKPGKAPKLLIYAASSLHSGVPSRFSGSGSGTDFALTISSLQPEDFATYYCQQSYSPPITFGQGTRLEIK

SEQ ID NO: 155 - DNA, 357 bp, Homo sapiens
caggtgcagctgcaggagtcgggcccaagactggtgaagccttcggagagcctgtccctcacctgcactgtctctggtggctccattagtaattccttctggggctggatccggcagcccccaggggagggactggagtggattggttatgtctataacagtggcaacaccaagtacaatccctccctcaagagtcgagtcaccatttcgcgcgacacgtccaagagtcaactctacatgaagctgaggtctgtgaccgccgctgacacggccgtgtactactgtgcgaggcatgacgacgcaagtcatggctacagcatctcctggggccacggaaccctggtcaccgtctcgagc

SEQ ID NO: 156 - protein, 119 aa, Homo sapiens
QVQLQESGPRLVKPSESLSLTCTVSGGSISNSFWGWIRQPPGEGLEWIGYVYNSGNTKYNPSLKSRVTISRDTSKSQLYMKLRSVTAADTAVYYCARHDDASHGYSISWGHGTLVTVSS

SEQ ID NO: 157 - DNA, 321 bp, Homo sapiens
gacatccagatgacccagtctccatcctccctgtctgcatctgtaggggacagagtcaccatcacttgccgggcaagtcagaccattagtacttatttaaattggtatcaacagaaatcagggaaagcccctaagctcctgatctatgctgcatccggtttgcaaagtggagtcccatcaaggttcagtggcagtggatctgggacagatttcactctcaccatcagcagtcttcaacctgaagattttgcaacttacttctgtcaacagagttacaatactcccctgacgttcggccaagggaccaaggtggaaatcaaa

SEQ ID NO: 158 - protein, 107 aa, Homo sapiens
DIQMTQSPSSLSASVGDRVTITCRASQTISTYLNWYQQKSGKAPKLLIYAASGLQSGVPSRFSGSGSGTDFTLTISSLQPEDFATYFCQQSYNTPLTFGQGTKVEIK

SEQ ID NO: 159 - DNA, 360 bp, Homo sapiens
caggtgcaactgcaggagtcgggcccaggactggtgaagccttcggagaccctgtccctcacctgcactgtctcgggtggctccatcagtgcttaccactggagctggatccgccagcccccagggaagggactggagtggattgggcacatctttgacagtgggagcacttactacaacccctcccttaagagtcgagtcaccatatcactagacgcgtccaagaaccagctctccctgagattgacctctgtgaccgcctcagacacggccatatattactgtgcgagacctctcgggagtcggtactattacggaatggacgtctggggccaagggaccacggtcaccgtctcgagc

SEQ ID NO: 160 - protein, 120 aa, Homo sapiens
QVQLQESGPGLVKPSETLSLTCTVSGGSISAYHWSWIRQPPGKGLEWIGHIFDSGSTYYNPSLKSRVTISLDASKNQLSLRLTSVTASDTAIYYCARPLGSRYYYGMDVWGQGTTVTVSS

SEQ ID NO: 161 - DNA, 318 bp, Homo sapiens
gacatccagatgacccagtctccgtcctccctgtctgcatctgtcggagacagagtcaccatcacttgccgggcaagtcagagtattagcaggtatttaaattggtatcagcagaaaccagggaaagcccctaagctcctgatctatggtgcctccactttgcaaaatggggccccatcaaggttcagcggcagtggatctgggacagatttcactctcaccatcagcagtctacaacctgaagattccgcaacttacctctgtcaacagagttacagtgtccctgctttcggcggaggaaccaaggtggaggtcaaa

SEQ ID NO: 162 - protein, 106 aa, Homo sapiens
DIQMTQSPSSLSASVGDRVTITCRASQSISRYLNWYQQKPGKAPKLLIYGASTLQNGAPSRFSGSGSGTDFTLTISSLQPEDSATYLCQQSYSVPAFGGGTKVEVK

SEQ ID NO: 163 - DNA, 363 bp, Homo sapiens
caggtccagctgcaggagtcgggcccaggactgctgaagccttcggacaccctggccctcacttgcactgtctctggtggctccatcaccagtgactactggagctggatccggcaacccccagggaggggactggactggatcggattcttctataacggcgggagcaccaagtacaatccctccctcaagagtcgagtcaccatatcagcggacacgtccaagaaccagttgtccctgaaattgacctctgtgaccgccgcagacacgggcgtgtattattgtgcgagacatgatgccaaatttagtgggagctactacgttgcctcctggggccagggaacccgagtcaccgtctcgagc

SEQ ID NO: 164 - protein, 121 aa, Homo sapiens; identical to SEQ ID NO: 120

SEQ ID NO: 165 - DNA, 321 bp, Homo sapiens
gacatccagatgacccagtctccctcctccctgtctgcatctgtaggagacagagtcaccatctcttgccgggcaagtcagagcattagcacctatttaaattggtatcagcagcaacctgggaaagcccctaaggtcctgatctctggtgcaaccgacttgcaaagtggggtcccatctcgcttcagtggcagtggatctgggacagatttcactctcaccatcagcagtctgcaacctgaagattttgcaacttactactgtcaacagagttacaatacccccctcatttttggccaggggaccaagctggagatcaaa

SEQ ID NO: 166 - protein, 107 aa, Homo sapiens
DIQMTQSPSSLSASVGDRVTISCRASQSISTYLNWYQQQPGKAPKVLISGATDLQSGVPSRFSGSGSGTDFTLTISSLQPEDFATYYCQQSYNTPLIFGQGTKLEIK

SEQ ID NO: 167 - DNA, 354 bp, Homo sapiens
gacatgcagctggtggagtctggaggaggcttggtcccgccgggggggtccctgagactctcctgcgcagcctctgggttttccgtcagtgacaactacataaactgggtccgccaggctccagggaaggggctggactgggtctcagtcttttatagtgctgatagaacatcctacgcagactccgtgaagggccgattcaccgtctccagccacgattccaagaacacagtgtaccttcaaatgaacagtctgagagctgaggacacggccgtttattactgtgcgagagttcagaagtcctattacggtatggacgtctggggccaagggaccacggtcaccgtctcgagc

SEQ ID NO: 168 - protein, 118 aa, Homo sapiens
DMQLVESGGGLVPPGGSLRLSCAASGFSVSDNYINWVRQAPGKGLDWVSVFYSADRTSYADSVKGRFTVSSHDSKNTVYLQMNSLRAEDTAVYYCARVQKSYYGMDVWGQGTTVTVSS

SEQ ID NO: 169 - DNA, 318 bp, Homo sapiens
ggcatccagatgacccagtctccatcctccctgtctgcatctgtaggagacagagtcaccatcacttgccgggcaagtcagagcattagcagatatttaaattggtatctgcagaaaccagggaaagcccctaagctcctgatctctggtgcatccagtttgcaaagtggggtcccatcaaggttcagtggcactgggtctgggacagaattcactctcaccatcagcagtttgcaacctgaagattttgcaacttactactgtcaacagactttcagtatccctctttttggccaggggaccaaggtggagatcaaa

SEQ ID NO: 170 - protein, 106 aa, Homo sapiens
GIQMTQSPSSLSASVGDRVTITCRASQSISRYLNWYLQKPGKAPKLLISGASSLQSGVPSRFSGTGSGTEFTLTISSLQPEDFATYYCQQTFSIPLFGQGTKVEIK

SEQ ID NO: 171 - DNA, 369 bp, Homo sapiens
caggtgcagctgcaggcgtcgggcccaggactggtgaagccttcagagaccctgtccctcacctgcactgtctctggtgactccatcaccagtggtgcttactactggacctggatccgccagcacccagggaagggcctggagtggattgggtacatctattacagtgggaacacctactacaacccgtccctcaagagtcgagttaccatatcactagacacgtctaagaaccagttctccctgaaggtgaactctgtgactgccgcggacacggccgtatattactgtgcgcgagctgcttcgacttcagtgctaggatacggtatggacgtctggggccaagggaccacggtcaccgtctcgagc

SEQ ID NO: 172 - protein, 123 aa, Homo sapiens
QVQLQASGPGLVKPSETLSLTCTVSGDSITSGAYYWTWIRQHPGKGLEWIGYIYYSGNTYYNPSLKSRVTISLDTSKNQFSLKVNSVTAADTAVYYCARAASTSVLGYGMDVWGQGTTVTVSS

SEQ ID NO: 173 - DNA, 321 bp, Homo sapiens
gacatccagatgacccagtctccatcctccctgtctgcatctgtaggagacagagtcaccatcacttgccgggcaagtcagagcattagcagatatttaaattggtatcagcaggaaccagggaaggcccctaagctcctggtctatgctgcatccagtttgcaaagtggggtcccatcaaggttcagtggcagtggatctgggacagatttcactctcaccataagcagtcttcaacctgaagattttgcaacttactactgtcaacagagttatagtacccccctcaccttcggccaagggacacgactggagattaaa

SEQ ID NO: 174 - protein, 107 aa, Homo sapiens
DIQMTQSPSSLSASVGDRVTITCRASQSISRYLNWYQQEPGKAPKLLVYAASSLQSGVPSRFSGSGSGTDFTLTISSLQPEDFATYYCQQSYSTPLTFGQGTRLEIK

SEQ ID NO: 175 - DNA, 354 bp, Homo sapiens; identical to SEQ ID NO: 167

SEQ ID NO: 176 - protein, 118 aa, Homo sapiens; identical to SEQ ID NO: 168

SEQ ID NO: 177 - DNA, 318 bp, Homo sapiens; identical to SEQ ID NO: 169

SEQ ID NO: 178 - protein, 106 aa, Homo sapiens; identical to SEQ ID NO: 170

SEQ ID NO: 179 - protein, 7 aa, Homo sapiens
GGGYSWN

SEQ ID NO: 180 - protein, 16 aa, Homo sapiens
FMFHSGSPRYNPTLKS

SEQ ID NO: 181 - protein, 12 aa, Homo sapiens
VGQMDKYYAMDV

SEQ ID NO: 182 - protein, 8 aa, Homo sapiens
GGPVSGGG

SEQ ID NO: 183 - protein, 9 aa, Homo sapiens
FMFHSGSPR

SEQ ID NO: 184 - protein, 11 aa, Homo sapiens
RASQSIGAYVN

SEQ ID NO: 185 - protein, 7 aa, Homo sapiens
GASNLQS

SEQ ID NO: 186 - protein, 9 aa, Homo sapiens
QQTYSTPIT

SEQ ID NO: 187 - protein, 5 aa, Homo sapiens
SDYWS

SEQ ID NO: 188 - protein, 16 aa, Homo sapiens
FFYNGGSTKYNPSLKS

SEQ ID NO: 189 - protein, 13 aa, Homo sapiens
HDAKFSGSYYVAS

SEQ ID NO: 190 - protein, 6 aa, Homo sapiens
GGSITS

SEQ ID NO: 191 - protein, 9 aa, Homo sapiens
FFYNGGSTK

SEQ ID NO: 192 - protein, 11 aa, Homo sapiens
RASQSISTYLN

SEQ ID NO: 193 - protein, 7 aa, Homo sapiens
GATNLQS

SEQ ID NO: 194 - protein, 9 aa, Homo sapiens
QQSYNTPLI

SEQ ID NO: 195 - DNA, 360 bp, Homo sapiens
gaggtgcagctggtggagtctgggggaggcttggtccagcctggggggtccctgagaatctcctgtgcagcctctggattcaccgtcagtagcaactacatgagttgggtccgccaggctccagggaaggggctggagtgggtctcagttatttatagtggtggtagcacatactacgcagactccgtgaagggcagattctccttctccagagacaactccaagaacacagtgtttcttcaaatgaacagcctgagagccgaggacacggctgtgtattactgtgcgagatgtctgagcaggatgcggggttacggtttagacgtctggggccaagggaccacggtcaccgtctcgagc

SEQ ID NO: 196 - DNA, 360 bp, Homo sapiens
caggtgcaattgcaggagtcgggcccaggactggtgaagccttcggagaccctgtccctcacctgcactgtctctggttcgtccatcagtaattactactggagctggatccggcagtccccagggaagggactggagtggattgggtttatctattacggtggaaacaccaagtacaatccctccctcaagagccgcgtcaccatatcacaagacacttccaagagtcaggtctccctgacgatgagctctgtgaccgctgcggaatcggccgtctatttctgtgcgagagcgtcttgtagtggtggttactgtatccttgactactggggccagggaaccctggtcaccgtctcgagc

SEQ ID NO: 197 - protein, 13 aa, Homo sapiens
HDVKFSGSYYVAS

SEQ ID NO: 198 - protein, 12 aa, Influenza A virus
GVTNKVNSIIDK

SEQ ID NO: 199 - protein, 115 aa, Homo sapiens
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSS

SEQ ID NO: 200 - protein, 5 aa, Influenza A virus
TGLRN

SEQ ID NO: 201 - protein, 12 aa, Influenza A virus
GVTNKVNRIIDK

SEQ ID NO: 202 - protein, 12 aa, Influenza A virus
GVTNKENSIIDK

SEQ ID NO: 203 - protein, 5 aa, Homo sapiens
SYNWI

SEQ ID NO: 204 - protein, 16 aa, Homo sapiens
HIYDYGRTFYNSSLQS

SEQ ID NO: 205 - protein, 12 aa, Homo sapiens
PLGILHYYAMDL

SEQ ID NO: 206 - protein, 6 aa, Homo sapiens
GGSISS

SEQ ID NO: 207 - protein, 9 aa, Homo sapiens
HIYDYGRTF

SEQ ID NO: 208 - protein, 11 aa, Homo sapiens
RASQSIDKFLN

SEQ ID NO: 209 - protein, 7 aa, Homo sapiens
GASNLHS

SEQ ID NO: 210 - protein, 8 aa, Homo sapiens
QQSFSVPA

SEQ ID NO: 211 - protein, 5 aa, Homo sapiens
STYMN

SEQ ID NO: 212 - protein, 16 aa, Homo sapiens
VFYSETRTYYADSVKG

SEQ ID NO: 213 - protein, 10 aa, Homo sapiens
VQRLSYGMDV

SEQ ID NO: 214 - protein, 6 aa, Homo sapiens
GLSVSS

SEQ ID NO: 215 - protein, 9 aa, Homo sapiens
VFYSETRTY

SEQ ID NO: 216 - protein, 12 aa, Influenza A virus
KITSKVNNIVDK

SEQ ID NO: 217 - protein, 7 aa, Homo sapiens
GASTLQS

SEQ ID NO: 218 - protein, 8 aa, Homo sapiens
QQTYSIPL

SEQ ID NO: 219 - protein, 14 aa, Homo sapiens
TGSSSNIGAGYDVH

SEQ ID NO: 220 - protein, 14 aa, Homo sapiens
IPHYNFGSGSYFDY

SEQ ID NO: 221 - protein, 17 aa, Homo sapiens
GIIAIFGTPKYAQKFQG

SEQ ID NO: 222 - protein, 5 aa, Homo sapiens
NYAMS

SEQ ID NO: 223 - protein, 7 aa, Homo sapiens
DNSDRPS

SEQ ID NO: 224 - protein, 11 aa, Homo sapiens
GGHNIGSNSVH

SEQ ID NO: 225 - protein, 12 aa, Influenza A virus
GITNKVNSIIDK

SEQ ID NO: 226 - protein, 7 aa, Homo sapiens
GASSLQS

SEQ ID NO: 227 - protein, 9 aa, Homo sapiens
QVWGSSSDH

SEQ ID NO: 228 - protein, 5 aa, Homo sapiens
SDFWS

SEQ ID NO: 229 - protein, 16 aa, Homo sapiens
YVYNRGSTKYSPSLKS

SEQ ID NO: 230 - protein, 12 aa, Homo sapiens
NGRSSTSWGIDV

SEQ ID NO: 231 - protein, 7 aa, Homo sapiens
GNSNRPS

SEQ ID NO: 232 - protein, 9 aa, Homo sapiens
YVYNRGSTK

SEQ ID NO: 233 - protein, 11 aa, Homo sapiens
RASQSISTYLH

SEQ ID NO: 234 - protein, 7 aa, Homo sapiens
AASSLQS

SEQ ID NO: 235 - protein, 120 aa, Homo sapiens
EVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQGTTVTVSS

SEQ ID NO: 236 - protein, 119 aa, Homo sapiens; identical to SEQ ID NO: 50

SEQ ID NO: 237 - protein, 16 aa, Homo sapiens
YIYNRGSTKYTPSLKS

SEQ ID NO: 238 - protein, 11 aa, Homo sapiens
HVGGHTYGIDY

SEQ ID NO: 239 - protein, 6 aa, Homo sapiens
GASISS

SEQ ID NO: 240 - protein, 9 aa, Homo sapiens
YIYNRGSTK

SEQ ID NO: 241 - protein, 11 aa, Homo sapiens
RASQSISNYLN

SEQ ID NO: 242 - protein, 5 aa, Homo sapiens
YYAMS

SEQ ID NO: 243 - protein, 9 aa, Homo sapiens
QQSYNTPIT

SEQ ID NO: 244 - DNA, 353 bp, Homo sapiens
gaggtgcagctggtggagtctgggggaggcttggtccagcctggggggtccctgagaatctcctgtgcagcctctggattcaccgtcagtagcaactacatgagttgggtccgccaggctccagggaaggggctggagtgggtctcagttatttatagtggtggtagcacatactacgcagactccgtgaagggcagattctccttctccagagacaactccaagaacacagtgtttcttcaaatgaacagcctgagagccgaggacacggctgtgtattactgtgcgagatgtctgagcaggatgcggggttacggtttagacgtctggggccaagggaccacggtcaccgt

SEQ ID NO: 245 - protein, 17 aa, Homo sapiens
KSSQSILNSSNNKNYLA

SEQ ID NO: 246 - protein, 19 aa, Homo sapiens
LNYHDSGTYYNAPRGWFDP

SEQ ID NO: 247 - protein, 5 aa, Homo sapiens
GYYVY

SEQ ID NO: 248 - protein, 17 aa, Homo sapiens
WISAYNGNTNYAQKFQG

SEQ ID NO: 249 - protein, 17 aa, Homo sapiens
GVIPIFRTANYAQNFQG

SEQ ID NO: 250 - protein, 9 aa, Homo sapiens
QQYYSSPPT

SEQ ID NO: 251 - protein, 5 aa, Homo sapiens
SYAIS

SEQ ID NO: 252 - protein, 5 aa, Homo sapiens
SYSWS

SEQ ID NO: 253 - protein, 16 aa, Homo sapiens
YLYYSGSTKYNPSLKS

SEQ ID NO: 254 - protein, 13 aa, Homo sapiens
TGSESTTGYGMDV

SEQ ID NO: 255 - protein, 6 aa, Homo sapiens
GDSISS

SEQ ID NO: 256 - protein, 9 aa, Homo sapiens
YLYYSGSTK

SEQ ID NO: 257 - protein, 12 aa, Influenza A virus
GITNKENSVIEK

SEQ ID NO: 258 - protein, 7 aa, Homo sapiens
AASSLHS

SEQ ID NO: 259 - protein, 9 aa, Homo sapiens
QQSYSPPIT

SEQ ID NO: 260 - protein, 5 aa, Homo sapiens
NSFWG

SEQ ID NO: 261 - protein, 16 aa, Homo sapiens
YVYNSGNTKYNPSLKS

SEQ ID NO: 262 - protein, 11 aa, Homo sapiens
HDDASHGYSIS

SEQ ID NO: 263 - protein, 6 aa, Homo sapiens
GGSISN

SEQ ID NO: 264 - protein, 9 aa, Homo sapiens
YVYNSGNTK

SEQ ID NO: 265 - protein, 11 aa, Homo sapiens
RASQTISTYLN

SEQ ID NO: 266 - protein, 12 aa, Homo sapiens
YWGQGTLVTVSS

SEQ ID NO: 267 - protein, 9 aa, Homo sapiens
QQSYNTPLT

SEQ ID NO: 268 - protein, 5 aa, Homo sapiens
AYHWS

SEQ ID NO: 269 - protein, 16 aa, Homo sapiens
HIFDSGSTYYNPSLKS

SEQ ID NO: 270 - protein, 12 aa, Homo sapiens
PLGSRYYYGMDV

SEQ ID NO: 271 - protein, 6 aa, Homo sapiens
GGSISA

SEQ ID NO: 272 - protein, 9 aa, Homo sapiens
HIFDSGSTY

SEQ ID NO: 273 - protein, 11 aa, Homo sapiens
RASQSISRYLN

SEQ ID NO: 274 - protein, 7 aa, Homo sapiens
GASTLQN

SEQ ID NO: 275 - protein, 8 aa, Homo sapiens
QQSYSVPA

SEQ ID NO: 276 - protein, 120 aa, Homo sapiens
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVTVSS

SEQ ID NO: 277 - protein, 117 aa, Homo sapiens
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVT

SEQ ID NO: 278 - DNA, 353 bp, Homo sapiens
caggtgcaattgcaggagtcgggcccaggactggtgaagccttcggagaccctgtccctcacctgcactgtctctggttcgtccatcagtaattactactggagctggatccggcagtccccagggaagggactggagtggattgggtttatctattacggtggaaacaccaagtacaatccctccctcaagagccgcgtcaccatatcacaagacacttccaagagtcaggtctccctgacgatgagctctgtgaccgctgcggaatcggccgtctatttctgtgcgagagcgtcttgtagtggtggttactgtatccttgactactggggccagggaaccctggtcaccgt

SEQ ID NO: 279 - DNA, 1335 bp, Homo sapiens
gaggtccagctggtgcagtctggggctgaggtgaagaagcctggggcctcagtgaaggtctcctgcaaggcttctgggtacaccttcaccggctactatgtgtactgggtgcgacaggcccctggacaagggcttgagtggatgggatggatcagcgcttacaatggtaacacaaactatgcacagaagttccagggcagagtcacgattaccgcggacaaatccacgagcacagcctacatggagctgagcagcctgagatctgaagacacggctgtgtattactgtgcgagaagtagatccctggacgtctggggccaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 280 - protein, 11 aa, Homo sapiens
GTWDSSLSAYV

SEQ ID NO: 281 - protein, 12 aa, Influenza A virus
GITNKVNSVIEK

SEQ ID NO: 282 - protein, 7 aa, Homo sapiens
GATDLQS

SEQ ID NO: 283 - protein, 12 aa, Influenza A virus
GVTNKVNSIINK

SEQ ID NO: 284 - protein, 5 aa, Influenza A virus
DNYIN

SEQ ID NO: 285 - protein, 16 aa, Homo sapiens
VFYSADRTSYADSVKG

SEQ ID NO: 286 - protein, 10 aa, Homo sapiens
VQKSYYGMDV

SEQ ID NO: 287 - protein, 6 aa, Homo sapiens
GFSVSD

SEQ ID NO: 288 - protein, 9 aa, Homo sapiens
VFYSADRTS

SEQ ID NO: 289 - protein, 9 aa, Homo sapiens
QQYYSTPLT

SEQ ID NO: 290 - protein, 11 aa, Homo sapiens
SSNYYDSVYDY

SEQ ID NO: 291 - protein, 8 aa, Homo sapiens
QQTFSIPL

SEQ ID NO: 292 - protein, 107 aa, Homo sapiens
DIQVTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVDIK

SEQ ID NO: 293 - protein, 7 aa, Homo sapiens
SGAYYWT

SEQ ID NO: 294 - protein, 16 aa, Homo sapiens
YIYYSGNTYYNPSLKS

SEQ ID NO: 295 - protein, 13 aa, Homo sapiens
AASTSVLGYGMDV

SEQ ID NO: 296 - protein, 8 aa, Homo sapiens
GDSITSGA

SEQ ID NO: 297 - protein, 9 aa, Homo sapiens
YIYYSGNTY

SEQ ID NO: 298 - skipped

SEQ ID NO: 299 - protein, 5 aa, Homo sapiens
SYAFS

SEQ ID NO: 300 - protein, 9 aa, Homo sapiens
QQSYSTPLT

SEQ ID NO: 301 - protein, 7 aa, Homo sapiens
VSDNYIN

SEQ ID NO: 302 - protein, 5 aa, Homo sapiens
TNAFS

SEQ ID NO: 303 - skipped

SEQ ID NO: 304 - protein, 5 aa, Homo sapiens
SGFSV

SEQ ID NO: 305 - protein, 5 aa, Homo sapiens
AYAFT

SEQ ID NO: 306 - protein, 17 aa, Homo sapiens
GIIAIFHTPKYAQKFQG

SEQ ID NO: 307 - protein, 17 aa, Homo sapiens
GISPMFGTTTYAQKFQG

SEQ ID NO: 308 - protein, 9 aa, Homo sapiens
QQYGSSSLT

SEQ ID NO: 309 - protein, 115 aa, Homo sapiens; identical to SEQ ID NO: 199

SEQ ID NO: 310 - protein, 114 aa, Homo sapiens
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKR

SEQ ID NO: 311 - DNA, 735 bp, Homo sapiens
gaggtccagctggtgcagtctggggctgaggtgaagaagcctggggcctcagtgaaggtctcctgcaaggcttctgggtacaccttcaccggctactatgtgtactgggtgcgacaggcccctggacaagggcttgagtggatgggatggatcagcgcttacaatggtaacacaaactatgcacagaagttccagggcagagtcacgattaccgcggacaaatccacgagcacagcctacatggagctgagcagcctgagatctgaagacacggctgtgtattactgtgcgagaagtagatccctggacgtctggggccaagggaccacggtcaccgtctcgagcggtacgggcggttcaggcggaaccggcagcggcactggcgggtcgacggatgttgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaagtggatatcaaacgt

SEQ ID NO: 312 - protein, 245 aa, Homo sapiens
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSSGTGGSGGTGSGTGGSTDVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKR

SEQ ID NO: 313 - protein, 121 aa, Homo sapiens [sequence omitted]

SEQ ID NO: 314 - protein, 111 aa, Homo sapiens
SYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLG

SEQ ID NO: 315 - DNA, 744 bp, Homo sapiens
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtattactgtgcgaaacatatggggtaccaggtgcgcgaaactatggacgtctggggcaaagggaccacggtcaccgtctcgagcggtacgggcggttcaggcggaaccggcagcggcactggcgggtcgacgtcctatgtgctgactcagccaccctcagcgtctgggacccccgggcagagggtcaccatctcttgttctggaagcacgttcaacatcggaagtaatgctgtagactggtaccggcagctcccaggaacggcccccaaactcctcatctatagtaataatcagcggccctcaggggtccctgaccgattctctggctccaggtctggcacctcagcctccctggccatcagtgggctccagtctgaggatgaggctgattattactgtgcagcatgggatgacatcctgaatgttccggtattcggcggagggaccaagctgaccgtcctaggt

SEQ ID NO: 316 - protein, 248 aa, Homo sapiens
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLG

SEQ ID NO: 317 - protein, 121 aa, Homo sapiens
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSS

SEQ ID NO: 318 - protein, 111 aa, Homo sapiens
QSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLG

SEQ ID NO: 319 - DNA, 744 bp, Homo sapiens
caggtccagctggtgcagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcggcactggcgggtcgacgcagtctgccctgactcagcctgccgccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgtcctaggt

SEQ ID NO: 320 - protein, 248 aa, Homo sapiens
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTQSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLG

SEQ ID NO: 321 - protein, 121 aa, Homo sapiens [sequence omitted]

SEQ ID NO: 322 - protein, 111 aa, Homo sapiens
SYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLG

SEQ ID NO: 323 - DNA, 744 bp, Homo sapiens
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcgacactggcgggtcgacgtcctatgtgctgactcagccaccctcagtctctgggacccccgggcagagggtcaccatctcttgctctggaagccgctccaacgtcggagataattctgtatattggtatcaacacgtcccagaaatggcccccaaactcctcgtctataagaatactcaacggccctcaggagtccctgcccggttttccggctccaagtctggcacttcagcctccctggccatcattggcctccagtccggcgatgaggctgattattattgtgtggcatgggatgacagcgtagatggctatgtcttcggatctgggaccaaggtcaccgtcctaggt

SEQ ID NO: 324 - protein, 248 aa, Homo sapiens
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLG

SEQ ID NO: 325 - protein, 121 aa, Homo sapiens [sequence omitted]

SEQ ID NO: 326 - protein, 111 aa, Homo sapiens
SVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 327 - DNA, 747 bp, Homo sapiens
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcggcactggcgggtcgacgcagtctgtgttgacgcagccgccctcagtgtctgcggccccaggacagaaggtcaccatctcctgctctggaagcagctccaacattgggaatgattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccaactattactgcgcaacatgggatcgccgcccgactgcttatgttgtcttcggcggagggaccaagctgaccgtcctaggt

SEQ ID NO: 328 - protein, 249 aa, Homo sapiens
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTQSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 329 - protein, 120 aa, Homo sapiens
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSS

SEQ ID NO: 330 - protein, 109 aa, Homo sapiens
DIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKR

SEQ ID NO: 331 - DNA, 735 bp, Homo sapiens
caggtacagctgcagcagtcaggggctgaggtgaagaagcctgggtcctcggtgaaggtctcctgcaaggtttccggagtcattttcagcggcagtgcgatcagctgggtgcgacaggcccctggacaaggccttgagtggatgggagggatcagccctctctttggcacaacaaattacgcacaaaagttccagggcagagtcacgattaccgcggaccaatccacgaacacaacctacatggaggtgaacagcctgagatatgaggacacggccgtgtatttctgtgcgcgaggtccaaaatattacagtgagtacatggacgtctggggcaaagggaccacggtcaccgtctcgagcggtacgggcggttcaggcggaaccggcagcggcactggcgggtcgacggacatccagatgacccagtctccatcctccctgtctgcatctgtaggagacagagtcaccatcacttgccgggcgagtcagggcattagcagttatttagcctggtatcagcagaagccagggaaagttcctacactcctgatctatgatgcatccactttgcgatcaggggtcccatctcgcttcagtggcagtggatctgcgacagatttcactctcaccatcagcagcctgcagcctgaagatgttgcaacttattactgtcaaaggtataacagtgcccccccgatcaccttcggccaagggacacgactggagattaaacgt

SEQ ID NO: 332 - protein, 245 aa, Homo sapiens
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSSGTGGSGGTGSGTGGSTDIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKR

SEQ ID NO: 333 - protein, 120 aa, Homo sapiens
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSS

SEQ ID NO: 334 - protein, 107 aa, Homo sapiens
QSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLG

SEQ ID NO: 335 - DNA, 729 bp, Homo sapiens
caggtccagctggtacagtctggggctgaggtgaagaagcctgggtcctcggtgaaggtctcctgcaaggcttctggaggcaccttcagtagttatgctatcagctgggtgcgacaggcccctggacaagggcttgagtggatgggaggaatcatgggtatgtttggcacaactaactacgcacagaagttccagggcagagtcacgattaccgcggacgaattcacgagcgcagcctacatggagctgaggagcctgagatctgaggacacggccgtctactactgtgcgaggtctagtggttattaccccgaatacttccaggactggggccagggcaccctggtcaccgtctcgagcggtacgggcggttcaggcggaaccggcagcggcactggcgggtcgacgcagtctgtgctgactcagccaccctcagagtccgtgtccccaggacagacagccagcgtcacctgctctggacataaattgggggataaatatgtttcgtggtatcagcagaagccaggccagtcccctgtattactcatctatcaagataacaggcggccctcagggatccctgagcgattcataggctccaactctgggaacacagccactctgaccatcagcgggacccaggctctggatgaggctgactattactgtcaggcgtgggacagcagcactgcggttttcggcggagggaccaagctgaccgtcctaggt

SEQ ID NO: 336 - protein, 243 aa, Homo sapiens
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSSGTGGSGGTGSGTGGSTQSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLG

SEQ ID NO: 337 - protein, 120 aa, Homo sapiens
QMQLVQSGAEVKKPGSSVKVSCKASGGTFSSYAITWVRQAPGQGLEWMGGIIGMFGSTNYAQNFQGRVTITADESTSTAYMELSSLRSEDTAVYYCARSTGYYPAYLHHWGQGTLVTVSS

SEQ ID NO: 338 - protein, 111 aa, Homo sapiens
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 339 - DNA, 741 bp, Homo sapiens
cagatgcagctggtgcagtctggggctgaggtgaagaagcctgggtcctcggtgaaggtctcctgcaaggcttctggaggcaccttctccagttatgctatcacctgggtgcgacaggcccctggacaagggcttgagtggatgggagggatcatcggtatgtttggttcaacaaactacgcacagaacttccagggcagagtcacgattaccgcggacgaatccacgagcacagcctacatggagctgagcagcctcagatctgaggacacggccgtgtattactgtgcgagaagtactggttattaccctgcatacctccaccactggggccagggcaccctggtcaccgtctcgagcggtacgggcggttcaggcggaaccggcagcggcactggcgggtcgacgcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgcagctcatatacaagcagcagcactcatgtcttcggaactgggaccaaggtcaccgtcctaggt

SEQ ID NO: 340 - protein, 246 aa, Homo sapiens
QMQLVQSGAEVKKPGSSVKVSCKASGGTFSSYAITWVRQAPGQGLEWMGGIIGMFGSTYAQNFQGRVTITADESTSTAYMELSSLRSEDTAVYYCARSTGYYPAYLHHWGQGTLVTVSSGTGGSGGTGSGTGGSTQSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 341 - protein, 121 aa, Homo sapiens
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSS

SEQ ID NO: 342 - protein, 109 aa, Homo sapiens
EIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKR

SEQ ID NO: 343 - DNA, 738 bp, Homo sapiens
gaggtgcagctggtggagaccggggctgaggtgaagaagcctggggcctcagtgaaggtttcctgcaaggcatctggatacaccttcaccagctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagaggggaaatggggacctcaagcggcttttgatatctggggccaagggacaatggtcaccgtctcgagcggtacgggcggttcaggcggaaccggcagtggcagtggcgggtcgacggaaattgtgatgacgcagtctccaggcaccctgtctttgtctccaggggaaagagccaccctctcctgcagggccagtcagagtgttagcagcagctacttagcctggtaccagcagaaacctggccaggctcccaggctcctcatctatgatgcatccagcagggccactgacatcccagacaggttcagtggcagtgggtctgggacagacttcactctcaccatcagcagactggagcctgaagattttgcagtgtattactgtcagcagtatggtagctcactttggacgttcggccaagggaccaaggtggagatcaaacgt

SEQ ID NO: 344 - protein, 246 aa, Homo sapiens
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSSGTGGSGGTGSGTGGSTEIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKR

SEQ ID NO: 345 - protein, 117 aa, Homo sapiens
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSS

SEQ ID NO: 346 - protein, 113 aa, Homo sapiens
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKR

SEQ ID NO: 347 - DNA, 738 bp, Homo sapiens
gaggtgcagctggtagagtctgggggaggcttggtacagcctggggggtccctgagactctcctgtgcagcctctggattcacctttagcatctatgccatgagctgggtccgccaggcaccagggaaggggctggagtgggtctcagctattagtagtagtggtgatagcacatactacgcagactccgtgaagggccggttcaccatctccagagacaacgccaggaacacgctgtatctgcaaatgaacagtctgagagccgaggacacggctgtgtattactgtgcgagagcgtatggctacacgttcgacccctggggccagggaaccctggtcaccgtctcgagcggtacgggcggttcaggcggaaccggcagcggcactggcgggtcgacggaaattgtgctgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccctcactttcggcggagggaccaaggtggagatcaaacgt

SEQ ID NO: 348 - protein, 246 aa, Homo sapiens
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSSGTGGSGGTGSGTGGSTEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKR

SEQ ID NO: 349 - protein, 122 aa, Homo sapiens
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSS

SEQ ID NO: 350 - protein, 108 aa, Homo sapiens
EIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 351 - DNA, 738 bp, Homo sapiens
caggtccagctggtgcagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgtagactcagtgaagggccgattcaccatctccagagacaacgccaagaactcactgtatctgcaaatgaacagcctgagagccgaggacacggctgtgtattactgtgcgagaggtggtgggagctacggggcctacgaaggctttgactactggggccagggcaccctggtcaccgtctcgagcggtacgggcggttcaggcggaaccggcagcggcactggcgggtcgacggaaattgtgctgactcagtctccaggcaccctgtctttgtctccaggggaaagagccaccctctcctgcagggccagtcagcgtgttagcagctacttagcctggtaccaacagaaacctggccaggctcccaggctcctcatctatggtgcatccaccagggccgctggcatcccagacaggttcagtggcagtgggtctgggacagacttcactctcaccatcagcagactggagcctgaagattctgcagtgtattactgtcagcagtatggtaggacaccgctcactttcggcggagggaccaaggtggagatcaaacgt

SEQ ID NO: 352 - protein, 246 aa, Homo sapiens
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSSGTGGSGGTGSGTGGSTEIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 353 - protein, 121 aa, Homo sapiens [sequence omitted]

SEQ ID NO: 354 - protein, 109 aa, Homo sapiens
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLG

SEQ ID NO: 355 - DNA, 738 bp, Homo sapiens
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagagcagagtcacgattaccacggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcggcactggcgggtcgacgtcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgctgtgttcggaggaggcacccagctgaccgtcctcggt

SEQ ID NO: 356 - protein, 246 aa, Homo sapiens
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLG

SEQ ID NO: 357 - protein, 121 aa, Homo sapiens [sequence omitted]

SEQ ID NO: 358 - protein, 111 aa, Homo sapiens
SYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLG

SEQ ID NO: 359 - DNA, 744 bp, Homo sapiens
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagcggtacgggcggttcaggcggaaccggcagcggcactggcgggtcgacgtcctatgtgctgactcagccaccctcagcgtctgggacccccgggcagagggtcaccatctcttgttctggaagcagctccaacatcggaagtaattatgtatactggtaccagcagctcccaggcacggcccccaaactcctcatctatagggatggtcagcggccctcaggggtccctgaccgattctctggctccaagtctggcacctcagcctccctggccatcagtggactccggtccgatgatgaggctgattattactgtgcaacatgggatgacaacctgagtggtccagtattcggcggagggaccaagctgaccgtcctaggt

SEQ ID NO: 360 - protein, 248 aa, Homo sapiens
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSGTGGSGGTGSGTGGSTSYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLG

SEQ ID NO: 361 - protein, 120 aa, Homo sapiens
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSS

SEQ ID NO: 362 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKR

SEQ ID NO: 363 - DNA, 735 bp, Homo sapiens
gaggtgcagctggtggagtctggggctgaggtgaagaagccagggtcctcggtgaaggtctcctgtaaggcctctggaggcaccttctccagctatggtatcagctgggtgcgacaggcccctggacaagggcttgagtggatgggagacatcatcggtatgtttggttcaacaaactacgcacagaacttccagggcagactcacgattaccgcggacgaatccacgagcacagcctacatggagctgagcagcctgagatctgaggacacggccgtgtattactgtgcgagaagtagtggttattaccctgcatacctcccccactggggccagggcaccttggtcaccgtctcgagcggtacgggcggttcaggcggaaccggcagcggcactggcgggtcgacggaaattgtgttgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccagaactttcggcggagggaccaaggtggagatcaaacgt

SEQ ID NO: 364 - protein, 245 aa, Homo sapiens
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSSGTGGSGGTGSGTGGSTEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKR

SEQ ID NO: 365 - protein, 121 aa, Homo sapiens
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSS

SEQ ID NO: 366 - protein, 111 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLG

SEQ ID NO: 367 - DNA, 744 bp, Homo sapiens
gaggtgcagctggtggagtctggggctgaggtgaagaagccggggtcctcggtgaaggtctcctgcaaggcttctggaggcaccttcagcttctattctatgagctgggtgcgacaggcccctggacaaggacttgagtggatgggagggatcatccctatgtttggtacaacaaactacgcacagaagttccagggcagagtcacgattaccgcggtcgaatccacgagcacagcctacatggaggtgagcagcctgagatctgaggacacggccgtttattactgtgcgagaggtgataagggtatctactactactacatggacgtctggggcaaagggaccacggtcaccgtctcgagcggtacgggcggttcaggcggaaccggcagcggcactggcgggtcgacgcagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactcttgtcttcggaactgggaccaaggtcaccgtcctaggt

SEQ ID NO: 368 - protein, 248 aa, Homo sapiens
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSSGTGGSGGTGSGTGGSTQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLG

SEQ ID NO: 369 - protein, 121 aa, Homo sapiens
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSS

SEQ ID NO: 370 - protein, 109 aa, Homo sapiens
SYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLG

SEQ ID NO: 371 - DNA, 738 bp, Homo sapiens
gaggtgcagctggtggagaccggggctgaggtgaagaagcctgggtcctcggtgaaggtctcctgcaaggcctctggaggcaccttcaggacccatgctatcagttgggtgcgacaggcccctggacaagggcttgagtggatgggagggatcatcgctatcttcggaacagcaaactacgcacagaagttccagggcagaatcacgattaccgcggacgaatccacgagtacagcctacatggagctgagcagcctgagatctgaggacacggccgtgtatttctgtgcgagaggcagtggttatcatatatcgacaccctttgacaactggggccagggaaccctggtcaccgtctcgagcggtacgggcggttcaggcggaaccggcagcggcactggcgggtcgacgtcctatgtgctgactcagccaccctcggtgtcagtggccccaggacagacggccaggattacctgtgggggaaacaacattggaagtaaaggtgtgcactggtaccagcagaagcctggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggt

SEQ ID NO: 372 - protein, 246 aa, Homo sapiens
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSSGTGGSGGTGSGTGGSTSYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLG

SEQ ID NO: 373 - protein, 128 aa, Homo sapiens
EVALVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSS

SEQ ID NO: 374 - protein, 108 aa, Homo sapiens
EIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKR

SEQ ID NO: 375 - DNA, 756 bp, Homo sapiens
gaggtgcagctggtggagtctggggctgaggtgaagaagcctgggtcctcggtgaaggtctcctgcaaggcttctggacacatcttcagcggctatgcaatcagttgggtgcgacaggcccctggacaagggcttgagtggatgggagggatcatccctatctttggtacaacaaactacgcacagaagttccagggcagagtcacgattaccgcggaccaatccacgagcacagcctacatggacctgagcaacttgagatctgaggacacggccgtctattactgtgcgagagtgaaagatggatattgtactcttaccagcggcactgtcggctggtacttcgatctctggggccgtggcaccctggtcactgtctcgagcggtacgggcggttcaggcggaaccggcagcggcactggcgggtcgacggaaattgtgatgacgcagtctccaggcaccctgtctttgtctccaggggaaagagccaccctctcgtgcagggccagtcagagtgttagcagcagctacttagcctggtaccagcagaaacctggccaggctcccaggctcctcatctttggtgcctccagcagggccactggcatcccagacaggttcagtggcagtgggtctgggacagacttcactctcaccatcagcagactggagcctgaagattttgcagtgtattactgtcagcagtatggtagctcactcactttcggcggagggaccaagctggagatcaaacgt

SEQ ID NO: 376 - protein, 252 aa, Homo sapiens
EVALVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSSGTGGSGGTGSGTGGSTEIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKR

SEQ ID NO: 377 - protein, 121 aa, Homo sapiens
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSS

SEQ ID NO: 378 - protein, 109 aa, Homo sapiens
EIVLTQSPGTLSLSPGERATLSCRASQSVSSNYLGWTQQKPGQAPRLLIYGASSRASGIPDRFSGGGSGTDFTLTISRLEPEDFAVYYCQQYGSSPLTFGGGTKVEIKR

SEQ ID NO: 379 - DNA, 738 bp, Homo sapiens
gaggtccagctggtacagtctggggctgaggttaagaagcctgggtcctcggtgaaggtctcctgcaaggcttctggaggcatcttcagaagcaattctatcagttgggtgcgacaggcccctgggcaagggcttgagtggatgggagggatcttcgctcttttcggaacaacagactacgcgcagaagttccagggcagagtcacgattaccgcggacgaatcttcgaccacagtctacctggagctgagtagcctgacatctgaggacacggccgtttattactgtgcgagaggcagtggctacaccacacgcaactactttgactactggggccagggcaccctggtcaccgtctcgagcggtacgggcggttcaggcggaaccggcagcggcactggcgggtcgacggaaattgtgctgactcagtctccaggcaccctgtctttgtctccaggggaaagagccacactctcctgcagggccagtcagagtgttagcagcaactacttaggctggtaccagcagaaacctggccaggctcccaggctcctgatctatggtgcatccagcagggccagtggcatcccagacaggttcagtggcggtgggtctgggacagacttcactctcaccatcagcagactggagcctgaagattttgcagtgtattactgtcagcagtatggtagctcacccctcactttcggcggagggaccaaggtggagatcaaacgt

SEQ ID NO: 380 - protein, 246 aa, Homo sapiens
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSSGTGGSGGTGSGTGGSTEIVLTQSPGTLSLSPGERATLSCRASQSVSSNYLGWTQQKPGQAPRLLIYGASSRASGIPDRFSGGGSGTDFTLTISRLEPEDFAVYYCQQYGSSPLTFGGGTKVEIKR

SEQ ID NO: 381 - protein, 120 aa, Homo sapiens
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSS

SEQ ID NO: 382 - protein, 109 aa, Homo sapiens
QSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLG

SEQ ID NO: 383 - DNA, 735 bp, Homo sapiens
gaggtgcagctggtggagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatcggtatgttcggtacagcaaactacgcacagaagttccagggcagagtcacgattaccgcggacgaatttacgagcacagcctacatggagctgagcagcctgagatctgaggacacggccgtgtattactgtgcgagaggaaattattactatgagagtagtctcgactactggggccagggaaccctggtcaccgtctcgagcggtacgggcggttcaggcggaaccggcagcggcactggcgggtcgacgcagtctgtcgtgacgcagccgccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtcttcggaactgggaccaaggtcaccgtcctaggt

SEQ ID NO: 384 - protein, 245 aa, Homo sapiens
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSSGTGGSGGTGSGTGGSTQSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLG

SEQ ID NO: 385 - protein, 120 aa, Homo sapiens
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSS

SEQ ID NO: 386 - protein, 107 aa, Homo sapiens
DIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKR

SEQ ID NO: 387 - DNA, 729 bp, Homo sapiens
caggtgcagctggtgcagtctggggctgaggtgaagaagcctgggtcctcggtaaaggtctcctgcaaggcttctggaggccccttccgcaattttgctatcaactgggtgcgacaggcccctggacaagggcttgagtggatgggagggatcatcgctgtctttgggacgacaaagtacgcacataagttccagggcagagtcaccatcaccgcggacgactccacaaatacagcttacatggagctgggcagcctgaaatctgaggacacggccgtgtattactgtgcgagaggtccccactactactcctcctacatggacgtctggggcgaagggaccacggtcaccgtctcgagcggtacgggcggttcaggcggaaccggcagcggcactggcgggtcgacggacatccagttgacccagtctccatcctccctgtctgcatctgtaggagacagagtcaccatcacttgccgggcgagtcagggcattagcacttatttagcctggtatcagcagaaacccgggaaagttcctaaactcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccttctttcggccctgggaccaaagtggatatcaaacgt

SEQ ID NO: 388 - protein, 243 aa, Homo sapiens
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSSGTGGDGGTGSGTGGSTDIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKR

SEQ ID NO: 389 - protein, 120 aa, Homo sapiens
EVALVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSS

SEQ ID NO: 390 - protein, 109 aa, Homo sapiens
SYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLG

SEQ ID NO: 391 - DNA, 735 bp, Homo sapiens
gaggtgcagctggtggagactggggctgaggtgaagaagcctgggtcctcggtgaaggtcccctgcaaatcttctggaagccccttcaggagtaatgctgtcagctgggtgcgacaggcccccggacaagggcttgagtgggtgggaggaatcctcggtgtctttggttcaccaagctacgcacagaagttccagggcagagtcacgattaccgcggacgaatccaccaacacagtccacatggagctgagaggtttgagatctgaggacacggccgtgtattattgtgcgagaggtcctacctactactactcctacatggacgtctggggcaaagggaccacggtcaccgtctcgagcggtacgggcggttcaggcggaaccggcagcggcactggcgggtcgacgtcctatgtgctgactcagccaccctcggagtcagtggccccaggacagacggccaggattacctgtgggggaaataacattggaagaaatagtgtgcactggtatcagcagaagccaggccaggcccctgtgctggtcgtgtatgatgatagcgaccggccctcagggatccctgagcgattttctggctccaagtctgggaacacggccaccctgattatcagcagggtcgaagtcggggatgaggccgactactactgtcaggtgtggcatagtagtagtgatcattatgtcttcggaactgggaccaaggtcaccgtcctaggt

SEQ ID NO: 392 - protein, 245 aa, Homo sapiens
EVALVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSSGTGGSGGTGSGTGGSTSYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLG

SEQ ID NO: 393 - protein, 120 aa, Homo sapiens
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSS

SEQ ID NO: 394 - protein, 109 aa, Homo sapiens
EIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKR

SEQ ID NO: 395 - DNA, 735 bp, Homo sapiens
cagatgcagctggtacaatctggagctgaggtgaagaagcctgggtcctcggtgaaggtctcctgcaaggcttctggaggcaccttcagcagctatgctatcagctgggtgcgacaggcccctggacaagggcttgagtggatgggagggatcttcggtatgtttgggacagcaaactacgcgcagaagttccagggcagagtcacgattaccgcggacgaattcacgagcgcggcctacatggagctgagcagcctgggatctgaggacacggccatgtattactgtgcgaggtctagtggttattacccccaatacttccaggactggggccagggcaccctggtcaccgtctcgagcggtacgggcggttcaggcggaaccggcagcggcactggcgggtcgacggaaattgtgatgacacagtctccaggcaccctgtctttgtctccagggcaaagagccaccctctcctgcagggccagtcagagtgttagcagcagctacttagcctggtaccagcagaarcctggccaggctcccagactcctcatgtatggtgcatccagcagggccactggcatcccagacaggttcagtggcagtgggtctgggacagacttcactctcaccatcagcagactggagcctgaagattttgcagtgtattactgtcagcagtatggtagctcatcgctcactttcggcggagggaccaagctggagatcaaacgt

SEQ ID NO: 396 - protein, 245 aa, Homo sapiens
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSSGTGGSGGTGSGTGGSTEIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKR

SEQ ID NO: 397 - protein, 121 aa, Homo sapiens
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSS

SEQ ID NO: 398 - protein, 109 aa, Homo sapiens
QAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 399 - DNA, 738 bp, Homo sapiens
gaggtgcagctggtggagtccggggctgaggtgaagaagcctgggtcctcggtgaaggtctcctgcaaggcttctggaggcatcttcaacagttatgctatcagctgggtgcgacaggcccctggacaagggcttgagtggatgggaggcatcatcgctatctttcatacaccaaagtacgcacagaagttccagggcagagtcacgattaccgcggacgaatccacgaacacagcctacatggaactgagaagcctgaaatctgaggacacggccctgtattactgtgcgagagggtccacttacgatttttcgagtggccttgactactggggccagggaaccctggtcaccgtctcgagcggtacgggcggttcaggcggaaccggcagcggcactggcgggtcgacgcaggcagggctgactcagccaccctcggtgtcagtggccccaggacagacggccaggattacctgtgggggaaacaacattggaagtaaaagtgtgcactggtaccagcagaagccaggccaggcccctgtcctagtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggt

SEQ ID NO: 400 - protein, 246 aa, Homo sapiens
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSSGTGGSGGTGSGTGGSTQAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 401 - protein, 126 aa, Homo sapiens
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSS

SEQ ID NO: 402 - protein, 114 aa, Homo sapiens
DIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKR

SEQ ID NO: 403 - DNA, 768 bp, Homo sapiens
caggtccagctggtgcagtctggggctgaggtgaagaagcctgggtcctcggtgaaggtctcctgcaaggcttctggaggcttcttcagcagctatgctatcagctgggtgcgccaggcccctggacaaggacttgagtggatggggggggtcatccctatctttcgtacagcaaactacgcacagaacttccagggcagagtcaccattaccgcggacgaattcacatcgtatatggagctgagcagcctgagatctgacgacacggccgtgtattactgtgcgaggttgaattaccatgattcggggacttattataacgccccccggggctggttcgacccctggggccagggaaccctggtcaccgtctcgagcggtacgggcggttcaggcggaaccggcagcggcactggcgggtcgacggacatccagatgacccagtctccagactccctggctgtgtctctgggcgagaaggccaccatcaactgcaagtccagccagagtattttaaacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtagtccgccgacgttcggccaagggaccaaggtggaaatcaaacgt

SEQ ID NO: 404 - protein, 256 aa, Homo sapiens
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSSGTGGSGGTGSGTGGSTDIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKR

SEQ ID NO: 405 - protein, 120 aa, Homo sapiens
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSS

SEQ ID NO: 406 - protein, 109 aa, Homo sapiens
QSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLG

SEQ ID NO: 407 - DNA, 735 bp, Homo sapiens
caggtccagctggtgcagtctggagctgaggtgaagaagcctgggtcctcggtgaaggtctcctgcaaggcttctggagtcaccttcagttactatgctatgagctgggtgcgacaggcccctggacaagggcttgagtggatgggaggaatcagccctatgtttgggacaacaacctacgcacagaagttccagggcagagtcacgattactgcggacgactccacgagtacagcctacatggaggtgaggagcctgagatctgaggacacggccgtgtattactgtgcgagatcttcgaattactatgatagtgtatatgactactggggccagggaaccctggtcaccgtctcgagcggtacgggcggttcaggcggaaccggcagcggcactggcgggtcgacgcagtctgtcgtgacgcagccgccctcggagtcagtggccccaggacagacggccaggattacctgtgggggacataacattggaagtaatagtgtgcactggtaccagcagaagccaggccaggcccctgtgctggtcgtgtatgataatagcgaccggccctcagggatccctgagcgattctctggctccaactctgggaacacggccaccctgaccatcagcagggtcgaagccyyygatgaggccgactattactgtcaggtgtggggtagtagtagtgaccattatgtcttcggaactgggaccaaggtcaccgtcctaggt

SEQ ID NO: 408 - protein, 245 aa, Homo sapiens
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSSGTGGSGGTGSGTGGSTQSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLG

SEQ ID NO: 409 - protein, 123 aa, Homo sapiens
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSS

SEQ ID NO: 410 - protein, 111 aa, Homo sapiens
TVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLG

SEQ ID NO: 411 - DNA, 750 bp, Homo sapiens
caggtgcagctggtgcagtctggggctgaggtgaagaagcctgggtcctcggtgagagtctcctgcaaggcttctggaagcatcttcagaaactatgctatgagctgggtgcgacaggcccctggacaagggcttgagtggatgggagggatcatcgctatttttgggacaccaaagtacgcacagaagttccagggcagagtcacgattaccgcggacgaatcgacgagcactgtctacatggaactgagcggactgagatctgaggacacggccatgtattactgtgcgaggattccccactataattttggttcggggagttatttcgactactggggccagggaaccctggtcaccgtctcgagcggtacgggcggttcaggcggaaccggcagcggcactggcgggtcgacgactgtgttgacacagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctaggt

SEQ ID NO: 412 - protein, 250 aa, Homo sapiens
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSSGTGGSGGTGSGTGGSTTVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLG

SEQ ID NO: 413 - protein, 445 aa, Homo sapiens
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - protein, 114 aa, Homo sapiens; identical to SEQ ID NO: 310

SEQ ID NO: 415 - DNA, 657 bp, Homo sapiens
gatgttgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaagtggatatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 416 - protein, 219 aa, Homo sapiens
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - protein, 121 aa, Homo sapiens [sequence omitted]

SEQ ID NO: 418 - DNA, 1353 bp, Homo sapiens
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 419 - protein, 451 aa, Homo sapiens
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 420 - protein, 111 aa, Homo sapiens; identical to SEQ ID NO: 314

SEQ ID NO: 421 - DNA, 660 bp, Homo sapiens
tcctatgtgctgactcagccaccctcagcgtctgggacccccgggcagagggtcaccatctcttgttctggaagcacgttcaacatcggaagtaatgctgtagactggtaccggcagctcccaggaacggcccccaaactcctcatctatagtaataatcagcggccctcaggggtccctgaccgattctctggctccaggtctggcacctcagcctccctggccatcagtgggctccagtctgaggatgaggctgattattactgtgcagcatgggatgacatcctgaatgttccggtattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 422 - protein, 220 aa, Homo sapiens
SYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 423 - protein, 121 aa, Homo sapiens; identical to SEQ ID NO: 317

SEQ ID NO: 424 - DNA, 1353 bp, Homo sapiens
caggtccagctggtgcagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 425 - protein, 451 aa, Homo sapiens
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 426 - protein, 111 aa, Homo sapiens; identical to SEQ ID NO: 318

SEQ ID NO: 427 - DNA, 660 bp, Homo sapiens
cagtctgccctgactcagcctgccgccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 428 - protein, 220 aa, Homo sapiens
QSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 429 - protein, 121 aa, Homo sapiens [sequence omitted]

SEQ ID NO: 430 - DNA, 1353 bp, Homo sapiens; identical to SEQ ID NO: 418

SEQ ID NO: 431 - protein, 451 aa, Homo sapiens; identical to SEQ ID NO: 419

SEQ ID NO: 432 - protein, 111 aa, Homo sapiens; identical to SEQ ID NO: 322

SEQ ID NO: 433 - DNA, 660 bp, Homo sapiens
tcctatgtgctgactcagccaccctcagtctctgggacccccgggcagagggtcaccatctcttgctctggaagccgctccaacgtcggagataattctgtatattggtatcaacacgtcccagaaatggcccccaaactcctcgtctataagaatactcaacggccctcaggagtccctgcccggttttccggctccaagtctggcacttcagcctccctggccatcattggcctccagtccggcgatgaggctgattattattgtgtggcatgggatgacagcgtagatggctatgtcttcggatctgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 434 - protein, 220 aa, Homo sapiens
SYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 435 - protein, 121 aa, Homo sapiens [sequence omitted]

SEQ ID NO: 436 - DNA, 1353 bp, Homo sapiens
gaggtgcagctggtggagtctggggctgaggtgaagaagcctgggtcctcggtgaaagtctcttgcaaggcttctggaggccccttccgcagctatgctatcagctgggtgcgacaggcccctggacaagggcctgagtggatgggagggatcatccctatttttggtacaacaaaatacgcaccgaagttccagggcagagtcacgattaccgcggacgatttcgcgggcacagtttacatggagctgagcagcctgcgatctgaggacacggccatgtactactgtgcgaaacatatggggtaccaggtgcgcgaaactatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccaaggacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 437 - protein, 451 aa, Homo sapiens; identical to SEQ ID NO: 419

SEQ ID NO: 438 - protein, 112 aa, Homo sapiens
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 439 - DNA, 660 bp, Homo sapiens
cagtctgtgttgacgcagccgccctcagtgtctgcggccccaggacagaaggtcaccatctcctgctctggaagcagctccaacattgggaatgattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccaactattactgcgcaacatgggatcgccgcccgactgcttatgttgtcttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgc

SEQ ID NO: 440 - protein, 221 aa, Homo sapiens
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 441 - protein, 120 aa, Homo sapiens; identical to SEQ ID NO: 329

SEQ ID NO: 442 - DNA, 1350 bp, Homo sapiens
caggtacagctgcagcagtcaggggctgaggtgaagaagcctgggtcctcggtgaaggtctcctgcaaggtttccggagtcattttcagcggcagtgcgatcagctgggtgcgacaggcccctggacaaggccttgagtggatgggagggatcagccctctctttggcacaacaaattacgcacaaaagttccagggcagagtcacgattaccgcggaccaatccacgaacacaacctacatggaggtgaacagcctgagatatgaggacacggccgtgtatttctgtgcgcgaggtccaaaatattacagtgagtacatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 443 - protein, 450 aa, Homo sapiens
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 444 - protein, 109 aa, Homo sapiens; identical to SEQ ID NO: 330

SEQ ID NO: 445 - DNA, 642 bp, Homo sapiens
gacatccagatgacccagtctccatcctccctgtctgcatctgtaggagacagagtcaccatcacttgccgggcgagtcagggcattagcagttatttagcctggtatcagcagaagccagggaaagttcctacactcctgatctatgatgcatccactttgcgatcaggggtcccatctcgcttcagtggcagtggatctgcgacagatttcactctcaccatcagcagcctgcagcctgaagatgttgcaacttattactgtcaaaggtataacagtgcccccccgatcaccttcggccaagggacacgactggagattaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 446 - protein, 214 aa, Homo sapiens
DIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 447 - protein, 120 aa, Homo sapiens; identical to SEQ ID NO: 333

SEQ ID NO: 448 - DNA, 1350 bp, Homo sapiens
caggtccagctggtacagtctggggctgaggtgaagaagcctgggtcctcggtgaaggtctcctgcaaggcttctggaggcaccttcagtagttatgctatcagctgggtgcgacaggcccctggacaagggcttgagtggatgggaggaatcatgggtatgtttggcacaactaactacgcacagaagttccagggcagagtcacgattaccgcggacgaattcacgagcgcagcctacatggagctgaggagcctgagatctgaggacacggccgtctactactgtgcgaggtctagtggttattaccccgaatacttccaggactggggccagggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 449 - protein, 450 aa, Homo sapiens
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 450 - protein, 107 aa, Homo sapiens; identical to SEQ ID NO: 334

SEQ ID NO: 451 - DNA, 648 bp, Homo sapiens
cagtctgtgctgactcagccaccctcagagtccgtgtccccaggacagacagccagcgtcacctgctctggacataaattgggggataaatatgtttcgtggtatcagcagaagccaggccagtcccctgtattactcatctatcaagataacaggcggccctcagggatccctgagcgattcataggctccaactctgggaacacagccactctgaccatcagcgggacccaggctctggatgaggctgactattactgtcaggcgtgggacagcagcactgcggttttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 452 - protein, 216 aa, Homo sapiens
QSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 453 - protein, 120 aa, Homo sapiens; identical to SEQ ID NO: 337

SEQ ID NO: 454 - DNA, 1350 bp, Homo sapiens
cagatgcagctggtgcagtctggggctgaggtgaagaagcctgggtcctcggtgaaggtctcctgcaaggcttctggaggcaccttctccagttatgctatcacctgggtgcgacaggcccctggacaagggcttgagtggatgggagggatcatcggtatgtttggttcaacaaactacgcacagaacttccagggcagagtcacgattaccgcggacgaatccacgagcacagcctacatggagctgagcagcctcagatctgaggacacggccgtgtattactgtgcgagaagtactggttattaccctgcatacctccaccactggggccagggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 455 - protein, 450 aa, Homo sapiens
QMQLVQSGAEVKKPGSSVKVSCKASGGTFSSYAITWVRQAPGQGLEWMGGIIGMFGSTNYAQNFQGRVTITADESTSTAYMELSSLRSEDTAVYYCARSTGYYPAYLHHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 456 - protein, 111 aa, Homo sapiens
GSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 457 - DNA, 660 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgcagctcatatacaagcagcagcactcatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 458 - protein, 220 aa, Homo sapiens
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 459 - protein, 121 aa, Homo sapiens; identical to SEQ ID NO: 341

SEQ ID NO: 460 - DNA, 1353 bp, Homo sapiens
gaggtgcagctggtggagaccggggctgaggtgaagaagcctggggcctcagtgaaggtttcctgcaaggcatctggatacaccttcaccagctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagaggggaaatggggacctcaagcggcttttgatatctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 461 - protein, 451 aa, Homo sapiens
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 462 - protein, 109 aa, Homo sapiens; identical to SEQ ID NO: 342

SEQ ID NO: 463 - DNA, 642 bp, Homo sapiens
gaaattgtgatgacgcagtctccaggcaccctgtctttgtctccaggggaaagagccaccctctcctgcagggccagtcagagtgttagcagcagctacttagcctggtaccagcagaaacctggccaggctcccaggctcctcatctatgatgcatccagcagggccactgacatcccagacaggttcagtggcagtgggtctgggacagacttcactctcaccatcagcagactggagcctgaagattttgcagtgtattactgtcagcagtatggtagctcactttggacgttcggccaagggaccaaggtggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 464 - protein, 214 aa, Homo sapiens
EIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 465 - protein, 117 aa, Homo sapiens; identical to SEQ ID NO: 345

SEQ ID NO: 466 - DNA, 1341 bp, Homo sapiens
gaggtgcagctggtagagtctgggggaggcttggtacagcctggggggtccctgagactctcctgtgcagcctctggattcacctttagcatctatgccatgagctgggtccgccaggcaccagggaaggggctggagtgggtctcagctattagtagtagtggtgatagcacatactacgcagactccgtgaagggccggttcaccatctccagagacaacgccaggaacacgctgtatctgcaaatgaacagtctgagagccgaggacacggctgtgtattactgtgcgagagcgtatggctacacgttcgacccctggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaagaacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 467 - protein, 447 aa, Homo sapiens
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 468 - protein, 113 aa, Homo sapiens; identical to SEQ ID NO: 346

SEQ ID NO: 469 - DNA, 654 bp, Homo sapiens
gaaattgtgctgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccctcactttcggcggagggaccaaggtggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 470 - protein, 218 aa, Homo sapiens
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 471 - protein, 122 aa, Homo sapiens; identical to SEQ ID NO: 349

SEQ ID NO: 472 - DNA, 1356 bp, Homo sapiens
caggtccagctggtgcagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgtagactcagtgaagggccgattcaccatctccagagacaacgccaagaactcactgtatctgcaaatgaacagcctgagagccgaggacacggctgtgtattactgtgcgagaggtggtgggagctacggggcctacgaaggctttgactactggggccagggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 473 - protein, 452 aa, Homo sapiens
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 474 - protein, 108 aa, Homo sapiens
EIVLYQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 475 - DNA, 639 bp, Homo sapiens
gaaattgtgctgactcagtctccaggcaccctgtctttgtctccaggggaaagagccaccctctcctgcagggccagtcagcgtgttagcagctacttagcctggtaccaacagaaacctggccaggctcccaggctcctcatctatggtgcatccaccagggccgctggcatcccagacaggttcagtggcagtgggtctgggacagacttcactctcaccatcagcagactggagcctgaagattctgcagtgtattactgtcagcagtatggtaggacaccgctcactttcggcggagggaccaaggtggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 476 - protein, 213 aa, Homo sapiens
EIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 477 - protein, 121 aa, Homo sapiens [sequence omitted]

SEQ ID NO: 478 - DNA, 1353 bp, Homo sapiens; identical to SEQ ID NO: 418

SEQ ID NO: 479 - protein, 451 aa, Homo sapiens; identical to SEQ ID NO: 419

SEQ ID NO: 480 - protein, 109 aa, Homo sapiens; identical to SEQ ID NO: 354

SEQ ID NO: 481 - DNA, 654 bp, Homo sapiens
tcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgctgtgttcggaggaggcacccagctgaccgtcctcggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 482 - protein, 218 aa, Homo sapiens
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 483 - protein, 121 aa, Homo sapiens [sequence omitted]

SEQ ID NO: 484 - DNA, 1353 bp, Homo sapiens; identical to SEQ ID NO: 418

SEQ ID NO: 485 - protein, 451 aa, Homo sapiens; identical to SEQ ID NO: 419

SEQ ID NO: 486 - protein, 111 aa, Homo sapiens; identical to SEQ ID NO: 358

SEQ ID NO: 487 - DNA, 660 bp, Homo sapiens
tcctatgtgctgactcagccaccctcagcgtctgggacccccgggcagagggtcaccatctcttgttctggaagcagctccaacatcggaagtaattatgtatactggtaccagcagctcccaggcacggcccccaaactcctcatctatagggatggtcagcggccctcaggggtccctgaccgattctctggctccaagtctggcacctcagcctccctggccatcagtggactccggtccgatgatgaggctgattattactgtgcaacatgggatgacaacctgagtggtccagtattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 488 - protein, 220 aa, Homo sapiens
SYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLGAAAQPKAAPSVTLFPPSSEELQANKATLVCLISDFYPGAVTVAWKADSSPVKAGVETTTPSKQSNNKYAASSYLSLTPGQWKSHRSYSCQVTHEGSTVEKTVAPTECSG

SEQ ID NO: 489 - protein, 120 aa, Homo sapiens; identical to SEQ ID NO: 361

SEQ ID NO: 490 - DNA, 1350 bp, Homo sapiens
gaggtgcagctggtggagtctggggctgaggtgaagaagccagggtcctcggtgaaggtctcctgtaaggcctctggaggcaccttctccagctatggtatcagctgggtgcgacaggcccctggacaagggcttgagtggatgggagacatcatcggtatgtttggttcaacaaactacgcacagaacttccagggcagactcacgattaccgcggacgaatccacgagcacagcctacatggagctgagcagcctgagatctgaggacacggccgtgtattactgtgcgagaagtagtggttattaccctgcatacctcccccactggggccagggcaccttggtcaccgtctcgagtgctagcaccaagggccccagcgtgttccccctggcccccagcagcaagagcaccagcggcggcacagccgccctgggctgcctggtgaaggactacttccccgagcccgtggacgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 491 - protein, 450 aa, Homo sapiens
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 492 - protein, 109 aa, Homo sapiens; identical to SEQ ID NO: 362

SEQ ID NO: 493 - DNA, 642 bp, Homo sapiens
gaaattgtgttgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccagaactttcggcggagggaccaaggtggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 494 - protein, 214 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 495 - protein, 121 aa, Homo sapiens; identical to SEQ ID NO: 365

SEQ ID NO: 496 - DNA, 1353 bp, Homo sapiens
gaggtgcagctggtggagtctggggctgaggtgaagaagccggggtcctcggtgaaggtctcctgcaaggcttctggaggcaccttcagcttctattctatgagctgggtgcgacaggcccctggacaaggacttgagtggatgggagggatcatccctatgtttggtacaacaaactacgcacagaagttccagggcagagtcacgattaccgcggtcgaatccacgagcacagcctacatggaggtgagcagcctgagatctgaggacacggccgtttattactgtgcgagaggtgataagggtatctactactactacatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 497 - protein, 451 aa, Homo sapiens
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 498 - protein, 111 aa, Homo sapiens; identical to SEQ ID NO: 366

SEQ ID NO: 499 - DNA, 660 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactcttgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 500 - protein, 220 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 501 - protein, 121 aa, Homo sapiens; identical to SEQ ID NO: 369

SEQ ID NO: 502 - DNA, 1353 bp, Homo sapiens
gaggtgcagctggtggagaccggggctgaggtgaagaagcctgggtcctcggtgaaggtctcctgcaaggcctctggaggcaccttcaggacccatgctatcagttgggtgcgacaggcccctggacaagggcttgagtggatgggagggatcatcgctatcttcggaacagcaaactacgcacagaagttccagggcagaatcacgattaccgcggacgaatccacgagtacagcctacatggagctgagcagcctgagatctgaggacacggccgtgtatttctgtgcgagaggcagtggttatcatatatcgacaccctttgacaactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 503 - protein, 451 aa, Homo sapiens
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 504 - protein, 109 aa, Homo sapiens; identical to SEQ ID NO: 370

SEQ ID NO: 505 - DNA, 654 bp, Homo sapiens
tcctatgtgctgactcagccaccctcggtgtcagtggccccaggacagacggccaggattacctgtgggggaaacaacattggaagtaaaggtgtgcactggtaccagcagaagcctggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 506 - protein, 218 aa, Homo sapiens
SYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 507 - protein, 128 aa, Homo sapiens
EVQLVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSS

SEQ ID NO: 508 - DNA, 1374 bp, Homo sapiens
gaggtgcagctggtggagtctggggctgaggtgaagaagcctgggtcctcggtgaaggtctcctgcaaggcttctggacacatcttcagcggctatgcaatcagttgggtgcgacaggcccctggacaagggcttgagtggatgggagggatcatccctatctttggtacaacaaactacgcacagaagttccagggcagagtcacgattaccgcggaccaatccacgagcacagcctacatggacctgagcaacttgagatctgaggacacggccgtctattactgtgcgagagtgaaagatggatattgtactcttaccagctgccctgtcggctggtacttcgatctctggggccgtggcaccctggtcactgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 509 - protein, 458 aa, Homo sapiens
EVQLVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 510 - protein, 108 aa, Homo sapiens; identical to SEQ ID NO: 374

SEQ ID NO: 511 - DNA, 639 bp, Homo sapiens
gaaattgtgatgacgcagtctccaggcaccctgtctttgtctccaggggaaagagccaccctctcgtgcagggccagtcagagtgttagcagcagctacttagcctggtaccagcagaaacctggccaggctcccaggctcctcatctttggtgcctccagcagggccactggcatcccagacaggttcagtggcagtgggtctgggacagacttcactctcaccatcagcagactggagcctgaagattttgcagtgtattactgtcagcagtatggtagctcactcactttcggcggagggaccaagctggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 512 - protein, 213 aa, Homo sapiens
EIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 513 - protein, 121 aa, Homo sapiens; identical to SEQ ID NO: 377

SEQ ID NO: 514 - DNA, 1353 bp, Homo sapiens
gaggtccagctggtacagtctggggctgaggttaagaagcctgggtcctcggtgaaggtctcctgcaaggcttctggaggcatcttcagaagcaattctatcagttgggtgcgacaggcccctgggcaagggcttgagtggatgggagggatcttcgctcttttcggaacaacagactacgcgcagaagttccagggcagagtcacgattaccgcggacgaatcttcgaccacagtctacctggagctgagtagcctgacatctgaggacacggccgtttattactgtgcgagaggcagtggctacaccacacgcaactactttgactactggggccagggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaggccccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagactggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 515 - protein, 451 aa, Homo sapiens
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 516 - protein, 109 aa, Homo sapiens
EIVLTQSPGTLSLSPGERATLSCRASQSVSSNYLGWYQQKPGQAPRLLIYGASSRASGIPDRFSGGGSGTDFTLTISRLEPEDFAVYYCQQYGSSPLTFGGGTKVEIKR

SEQ ID NO: 517 - DNA, 654 bp, Homo sapiens
gaaattgtgctgactcagtctccaggcaccctgtctttgtctccaggggaaagagccacactctcctgcagggccagtcagagtgttagcagcaactacttaggctggtaccagcagaaacctggccaggctcccaggctcctgatctatggtgcatccagcagggccagtggcatcccagacaggttcagtggcggtgggtctgggacagacttcactctcaccatcagcagactggagcctgaagattttgcagtgtattactgtcagcagtatggtagctcacccctcactttcggcggagggaccaaggtggagatcaaacgtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacaccacccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 518 - protein, 218 aa, Homo sapiens
EIVLTQSPGTLSLSPGERATLSCRASQSVSSNYLGWYQQKPGQAPRLLIYGASSRASGIPDRFSGGGSGTDFTLTISRLEPEDFAVYYCQQYGSSPLTFGGGTKVEIKRAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 519 - protein, 120 aa, Homo sapiens; identical to SEQ ID NO: 381

SEQ ID NO: 520 - DNA, 1350 bp, Homo sapiens
gaggtgcagctggtggagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatcggtatgttcggtacagcaaactacgcacagaagttccagggcagagtcacgattaccgcggacgaatttacgagcacagcctacatggagctgagcagcctgagatctgaggacacggccgtgtattactgtgcgagaggaaattattactatgagagtagtctcgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggtggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 521 - protein, 450 aa, Homo sapiens
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 109 aa, Homo sapiens; identical to SEQ ID NO: 382

SEQ ID NO: 523 - DNA, 654 bp, Homo sapiens
cagtctgtcgtgacgcagccgccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 524 - protein, 218 aa, Homo sapiens
QSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 525 - protein, 120 aa, Homo sapiens; identical to SEQ ID NO: 385

SEQ ID NO: 526 - DNA, 1350 bp, Homo sapiens
caggtgcagctggtgcagtctggggctgaggtgaagaagcctgggtcctcggtaaaggtctcctgcaaggcttctggaggccccttccgcaattttgctatcaactgggtgcgacaggcccctggacaagggcttgagtggatgggagggatcatcgctgtctttgggacgacaaagtacgcacataagttccagggcagagtcaccatcaccgcggacgactccacaaatacagcttacatggagctgggcagcctgaaatctgaggacacggccgtgtattactgtgcgagaggtccccactactactcctcctacatggacgtctggggcgaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 527 - protein, 450 aa, Homo sapiens
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 528 - protein, 107 aa, Homo sapiens; identical to SEQ ID NO: 386

SEQ ID NO: 529 - DNA, 636 bp, Homo sapiens
gacatccagttgacccagtctccatcctccctgtctgcatctgtaggagacagagtcaccatcacttgccgggcgagtcagggcattagcacttatttagcctggtatcagcagaaacccgggaaagttcctaaactcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccttctttcggccctgggaccaaagtggatatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 530 - protein, 212 aa, Homo sapiens
DIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 531 - protein, 120 aa, Homo sapiens
EVQLVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSS

SEQ ID NO: 532 - DNA, 1350 bp, Homo sapiens
gaggtgcagctggtggagactggggctgaggtgaagaagcctgggtcctcggtgaaggtcccctgcaaatcttctggaagccccttcaggagtaatgctgtcagctgggtgcgacaggcccccggacaagggcttgagtgggtgggaggaatcctcggtgtctttggttcaccaagctacgcacagaagttccagggcagagtcacgattaccgcggacgaatccaccaacacagtccacatggagctgagaggtttgagatctgaggacacggccgtgtattattgtgcgagaggtcctacctactactactcctacatggacgtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggtgaccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggaatgagagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 533 - protein, 450 aa, Homo sapiens [sequence omitted]

SEQ ID NO: 534 - protein, 109 aa, Homo sapiens; identical to SEQ ID NO: 390

SEQ ID NO: 535 - DNA, 654 bp, Homo sapiens
tcctatgtgctgactcagccaccctcggagtcagtggccccaggacagacggccaggattacctgtgggggaaataacattggaagaaatagtgtgcactggtatcagcagaagccaggccaggcccctgtgctggtcgtgtatgatgatagcgaccggccctcagggatccctgagcgattttctggctccaagtctgggaacacggccaccctgattatcagcagggtcgaagtcggggatgaggccgactactactgtcaggtgtggcatagtagtagtgatcattatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 536 - protein, 218 aa, Homo sapiens
SYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 537 - protein, 120 aa, Homo sapiens; identical to SEQ ID NO: 393

SEQ ID NO: 538 - DNA, 1350 bp, Homo sapiens
cagatgcagctggtacaatctggagctgaggtgaagaagcctgggtcctcggtgaaggtctcctgcaaggcttctggaggcaccttcagcagctatgctatcagctgggtgcgacaggcccctggacaagggcttgagtggatgggagggatcttcggtatgtttgggacagcaaactacgcgcagaagttccagggcagagtcacgattaccgcggacgaattcacgagcgcggcctacatggagctgagcagcctgggatctgaggacacggccatgtattactgtgcgaggtctagtggttattacccccaatacttccaggactggggccagggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 539 - protein, 450 aa, Homo sapiens
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 109 aa, Homo sapiens; identical to SEQ ID NO: 394

SEQ ID NO: 541 - DNA, 642 bp, Homo sapiens
gaaattgtgatgacacagtctccaggcaccctgtctttgtctccagggcaaagagccaccctctcctgcagggccagtcagagtgttagcagcagctacttagcctggtaccagcagaaacctggccaggctcccagactcctcatgtatggtgcatccagcagggccactggcatcccagacaggttcagtggcagtgggtctgggacagacttcactctcaccatcagcagactggagcctgaagattttgcagtgtattactgtcagcagtatggtagctcatcgctcactttcggcggagggaccaagctggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 542 - protein, 214 aa, Homo sapiens
EIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 543 - protein, 121 aa, Homo sapiens; identical to SEQ ID NO: 397

SEQ ID NO: 544 - protein, 5 aa, Homo sapiens
DIKRT

SEQ ID NO: 545 - DNA, 1353 bp, Homo sapiens
gaggtgcagctggtggagtccggggctgaggtgaagaagcctgggtcctcggtgaaggtctcctgcaaggcttctggaggcatcttcaacagttatgctatcagctgggtgcgacaggcccctggacaagggcttgagtggatgggaggcatcatcgctatctttcatacaccaaagtacgcacagaagttccagggcagagtcacgattaccgcggacgaatccacgaacacagcctacatggaactgagaagcctgaaatctgaggacacggccctgtattactgtgcgagagggtccacttacgatttttcgagtggccttgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 546 - protein, 451 aa, Homo sapiens
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 547 - protein, 109 aa, Homo sapiens; identical to SEQ ID NO: 398

SEQ ID NO: 548 - DNA, 654 bp, Homo sapiens
caggcagggctgactcagccaccctcggtgtcagtggccccaggacagacggccaggattacctgtgggggaaacaacattggaagtaaaagtgtgcactggtaccagcagaagccaggccaggcccctgtcctagtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 549 - protein, 218 aa, Homo sapiens
QAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 550 - protein, 126 aa, Homo sapiens; identical to SEQ ID NO: 401

SEQ ID NO: 551 - DNA, 1368 bp, Homo sapiens
caggtccagctggtgcagtctggggctgaggtgaagaagcctgggtcctcggtgaaggtctcctgcaaggcttctggaggcttcttcagcagctatgctatcagctgggtgcgccaggcccctggacaaggacttgagtggatggggggggtcatccctatctttcgtacagcaaactacgcacagaacttccagggcagagtcaccattaccgcggacgaattcacatcgtatatggagctgagcagcctgagatctgacgacacggccgtgtattactgtgcgaggttgaattaccatgattcggggacttattataacgccccccggggctggttcgacccctggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 552 - protein, 456 aa, Homo sapiens
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 553 - protein, 114 aa, Homo sapiens; identical to SEQ ID NO: 402

SEQ ID NO: 554 - DNA, 657 bp, Homo sapiens
gacatccagatgacccagtctccagactccctggctgtgtctctgggcgagaaggccaccatcaactgcaagtccagccagagtattttaaacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtagtccgccgacgttcggccaagggaccaaggtggaaatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 555 - protein, 219 aa, Homo sapiens
DIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 556 - protein, 120 aa, Homo sapiens; identical to SEQ ID NO: 405

SEQ ID NO: 557 - DNA, 1350 bp, Homo sapiens
caggtccagctggtgcagtctggagctgaggtgaagaagcctgggtcctcggtgaaggtctcctgcaaggcttctggagtcaccttcagttactatgctatgagctgggtgcgacaggcccctggacaagggcttgagtggatgggaggaatcagccctatgtttgggacaacaacctacgcacagaagttccagggcagagtcacgattactgcggacgactccacgagtacagcctacatggaggtgaggagcctgagatctgaggacacggccgtgtattactgtgcgagatcttcgaattactatgatagtgtatatgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggtggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 558 - protein, 450 aa, Homo sapiens
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 559 - protein, 109 aa, Homo sapiens; identical to SEQ ID NO: 406

SEQ ID NO: 560 - DNA, 654 bp, Homo sapiens
cagtctgtcgtgacgcagccgccctcggagtcagtggccccaggacagacggccaggattacctgtgggggacataacattggaagtaatagtgtgcactggtaccagcagaagccaggccaggcccctgtgctggtcgtgtatgataatagcgaccggccctcagggatccctgagcgattctctggctccaactctgggaacacggccaccctgaccatcagcagggtcgaagccggggatgaggccgactattactgtcaggtgtggggtagtagtagtgaccattatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 561 - protein, 218 aa, Homo sapiens
QSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 562 - protein, 123 aa, Homo sapiens; identical to SEQ ID NO: 409

SEQ ID NO: 563 - DNA, 1359 bp, Homo sapiens
caggtgcagctggtgcagtctggggctgaggtgaagaagcctgggtcctcggtgagagtctcctgcaaggcttctggaagcatcttcagaaactatgctatgagctgggtgcgacaggcccctggacaagggcttgagtggatgggagggatcatcgctatttttgggacaccaaagtacgcacagaagttccagggcagagtcacgattaccgcggacgaatcgacgagcactgtctacatggaactgagcggactgagatctgaggacacggccatgtattactgtgcgaggattccccactataattttggttcggggagttatttcgactactggggccagggaaccctggtcaccggcttgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 564 - protein, 453 aa, Homo sapiens
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 565 - protein, 111 aa, Homo sapiens; identical to SEQ ID NO: 410

SEQ ID NO: 566 - protein, 660 aa, Homo sapiens
ACTGTGTTGACACAGCCGCCCTCAGTGTCTGGGGCCCCAGGGCAGAGGGTCACCATCTCCTGCACTGGGAGCAGCTCCAACATCGGGGCAGGTTATGATGTACACTGGTACCAGCAGCTTCCAGGAACAGCCCCCAAACTCCTCATCTATGGTAACAGCAATCGGCCCTCAGGGGTCCCTGACCGATTCTCTGGCTCCAAGTCTGGCACGTCAGCCACCCTGGGCATCACCGGACTCCAGACTGGGGACGAGGCCGATTATTACTGCGGAACATGGGATAGCAGCCTGAGTGCTTATGTCTTCGGAACTGGGACCAAGGTCACCGTCCTAGGTGCGGCCGCAGGCCAGCCCAAGGCCGCTCCCAGCGTGACCCTGTTCCCCCCCTCCTCCGAGGAGCTGCAGGCCAACAAGGCCACCCTGGTGTGCCTCATCAGCGACTTCTACCCTGGCGCCGTGACCGTGGCCTGGAAGGCCGACAGCAGCCCCGTGAAGGCCGGCGTGGAGACCACCACCCCCAGCAAGCAGAGCAACAACAAGTACGCCGCCAGCAGCTACCTGAGCCTCACCCCCGAGCAGTGGAAGAGCCACCGGAGCTACAGCTGCCAGGTGACCCACGAGGGCAGCACCGTGGAGAAGACCGTGGCCCCCACCGAGTGCAGC

SEQ ID NO: 567 - protein, 220 aa, Homo sapiens
TVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 568 - protein, 6 aa, Homo sapiens
SRSLDV

SEQ ID NO: 569 - protein, 17 aa, Homo sapiens
KSSQSVLYSSNNKNYLA

SEQ ID NO: 570 - protein, 7 aa, Homo sapiens
WASTRES

SEQ ID NO: 571 - protein, 5 aa, Homo sapiens
SYAIS

SEQ ID NO: 572 - protein, 17 aa, Homo sapiens
GIIPIFGTTKYAPKFQG

SEQ ID NO: 573 - protein, 12 aa, Homo sapiens
HMGYQVRETMDV

SEQ ID NO: 574 - protein, 13 aa, Homo sapiens
SGSTFNIGSNAVD

SEQ ID NO: 575 - protein, 7 aa, Homo sapiens
SNNQRPS

SEQ ID NO: 576 - protein, 11 aa, Homo sapiens
AAWDDILNVPV

SEQ ID NO: 577 - protein, 14 aa, Homo sapiens
TGTSSDVGGYNYVS

SEQ ID NO: 578 - protein, 7 aa, Homo sapiens
EVSNRPS

SEQ ID NO: 579 - protein, 9 aa, Homo sapiens
SSYTSSSTY

SEQ ID NO: 580 - protein, 13 aa, Homo sapiens
SGSRSNVGDNSVY

SEQ ID NO: 581 - protein, 7 aa, Homo sapiens
KNTQRPS

SEQ ID NO: 582 - protein, 11 aa, Homo sapiens
VAWDDSVDGYV

SEQ ID NO: 583 - protein, 13 aa, Homo sapiens
SGSSSNIGNDYVS

SEQ ID NO: 584 - protein, 7 aa, Homo sapiens
DNNKRPS

SEQ ID NO: 585 - protein, 12 aa, Homo sapiens
ATWDRRPTAYVV

SEQ ID NO: 586 - protein, 5 aa, Homo sapiens
GSAIS

SEQ ID NO: 587 - protein, 17 aa, Homo sapiens
GISPLFGTTNYAQKFQG

SEQ ID NO: 588 - protein, 11 aa, Homo sapiens
GPKYYSEYMDV

SEQ ID NO: 589 - protein, 11 aa, Homo sapiens
RASQGISSYLA

SEQ ID NO: 590 - protein, 7 aa, Homo sapiens
DASTLRS

SEQ ID NO: 591 - protein, 9 aa, Homo sapiens
QRYNSAPPI

SEQ ID NO: 592 - protein, 17 aa, Homo sapiens
GIMGMFGTTNYAQKFQG

SEQ ID NO: 593 - protein, 11 aa, Homo sapiens
SSGYYPEYFQD

SEQ ID NO: 594 - protein, 11 aa, Homo sapiens
SGHKLGDKYVS

SEQ ID NO: 595 - protein, 7 aa, Homo sapiens
QDNRRPS

SEQ ID NO: 596 - protein, 8 aa, Homo sapiens
QAWDSSTA

SEQ ID NO: 597 - protein, 5 aa, Homo sapiens
SYAIT

SEQ ID NO: 598 - protein, 17 aa, Homo sapiens
GIIGMFGSTNYAQNFQG

SEQ ID NO: 599 - protein, 11 aa, Homo sapiens
STGYYPAYLHH

SEQ ID NO: 600 - protein, 5 aa, Homo sapiens
SFAIS

SEQ ID NO: 601 - protein, 7 aa, Homo sapiens
DVSKRPS

SEQ ID NO: 602 - protein, 10 aa, Homo sapiens
SSYTSSSTHV

SEQ ID NO: 603 - protein, 5 aa, Homo sapiens
SYYMH

SEQ ID NO: 604 - protein, 17 aa, Homo sapiens
WINPNSGGTNYAQKFQG

SEQ ID NO: 605 - protein, 12 aa, Homo sapiens
EGKWGPQAAFDI

SEQ ID NO: 606 - protein, 5 aa, Homo sapiens
SYAIS

SEQ ID NO: 607 - protein, 7 aa, Homo sapiens
DASSRAT

SEQ ID NO: 608 - protein, 8 aa, Homo sapiens
QQYGSSLW

SEQ ID NO: 609 - protein, 5 aa, Homo sapiens
IYAMS

SEQ ID NO: 610 - protein, 17 aa, Homo sapiens
AISSSGDSTYYADSVKG

SEQ ID NO: 611 - protein, 8 aa, Homo sapiens
AYGYTFDP

SEQ ID NO: 612 - protein, 16 aa, Homo sapiens
RSSQSLLHSNGYNYLD

SEQ ID NO: 613 - protein, 7 aa, Homo sapiens
LGSNRAS

SEQ ID NO: 614 - protein, 8 aa, Homo sapiens
MQALQTPL

SEQ ID NO: 615 - protein, 5 aa, Homo sapiens
SYSMN

SEQ ID NO: 616 - protein, 17 aa, Homo sapiens
SISSSSSYIYYVDSVKG

SEQ ID NO: 617 - protein, 13 aa, Homo sapiens
GGGSYGAYEGFDY

SEQ ID NO: 618 - protein, 11 aa, Homo sapiens
RASQRVSSYLA

SEQ ID NO: 619 - protein, 7 aa, Homo sapiens
GASTRAA

SEQ ID NO: 620 - protein, 9 aa, Homo sapiens
QQYGRTPLT

SEQ ID NO: 621 - protein, 11 aa, Homo sapiens
GGNNIGSKSVH

SEQ ID NO: 622 - protein, 7 aa, Homo sapiens
DDSDRPS

SEQ ID NO: 623 - protein, 11 aa, Homo sapiens
QVWDSSSDHAV

SEQ ID NO: 624 - protein, 13 aa, Homo sapiens
SGSSSNIGSNYVY

SEQ ID NO: 625 - protein, 7 aa, Homo sapiens
RDGQRPS

SEQ ID NO: 626 - protein, 11 aa, Homo sapiens
ATWDDNLSGPV

SEQ ID NO: 627 - protein, 5 aa, Homo sapiens
SYGIS

SEQ ID NO: 628 - protein, 17 aa, Homo sapiens
DIIGMFGSTNYAQNFQG

SEQ ID NO: 629 - protein, 11 aa, Homo sapiens
SSGYYPAYLPH

SEQ ID NO: 630 - protein, 5 aa, Homo sapiens
GYYIH

SEQ ID NO: 631 - protein, 7 aa, Homo sapiens
GASSRAT

SEQ ID NO: 632 - protein, 9 aa, Homo sapiens
QQYGSSPRT

SEQ ID NO: 633 - protein, 5 aa, Homo sapiens
FYSMS

SEQ ID NO: 634 - protein, 17 aa, Homo sapiens
GIIPMFGTTNYAQKFQG

SEQ ID NO: 635 - protein, 12 aa, Homo sapiens
GDKGIYYYYMDV

SEQ ID NO: 636 - protein, 10 aa, Homo sapiens
SSYTSSSTLV

SEQ ID NO: 637 - protein, 5 aa, Homo sapiens
THAIS

SEQ ID NO: 638 - protein, 17 aa, Homo sapiens
GIIAIFGTANYAQKFQG

SEQ ID NO: 639 - protein, 12 aa, Homo sapiens
GSGYHISTPFDN

SEQ ID NO: 640 - protein, 11 aa, Homo sapiens
GGNNIGSKGVH

SEQ ID NO: 641 - protein, 5 aa, Homo sapiens
MTAFT

SEQ ID NO: 642 - protein, 11 aa, Homo sapiens
QVWDSSSDHVV

SEQ ID NO: 643 - protein, 5 aa, Homo sapiens
GYAIS

SEQ ID NO: 644 - protein, 17 aa, Homo sapiens
GIIPIFGTTNYAQKFQG

SEQ ID NO: 645 - protein, 19 aa, Homo sapiens
VKDGYCTLTSCPVGWYFDL

SEQ ID NO: 646 - protein, 12 aa, Homo sapiens
RASQSVSSSYLA

SEQ ID NO: 647 - protein, 5 aa, Homo sapiens
MTAFT

SEQ ID NO: 648 - protein, 8 aa, Homo sapiens
QQYGSSLT

SEQ ID NO: 649 - protein, 5 aa, Homo sapiens
SNSIS

SEQ ID NO: 650 - protein, 17 aa, Homo sapiens
GIFALFGTTDYAQKFQG

SEQ ID NO: 651 - protein, 12 aa, Homo sapiens
GSGYTTRNYFDY

SEQ ID NO: 652 - protein, 12 aa, Homo sapiens
RASQSVSSNYLG

SEQ ID NO: 653 - protein, 7 aa, Homo sapiens
GASSRAS

SEQ ID NO: 654 - protein, 9 aa, Homo sapiens
QQYGSSPLT

SEQ ID NO: 655 - protein, 17 aa, Homo sapiens
GIIGMFGTANYAQKFQG

SEQ ID NO: 656 - protein, 11 aa, Homo sapiens
GNYYYESSLDY

SEQ ID NO: 657 - protein, 9 aa, Homo sapiens
QVWDSSSDH

SEQ ID NO: 658 - protein, 5 aa, Homo sapiens
NFAIN

SEQ ID NO: 659 - protein, 17 aa, Homo sapiens
GIIAVFGTTKYAHKFQG

SEQ ID NO: 660 - protein, 11 aa, Homo sapiens
GPHYYSSYMDV

SEQ ID NO: 661 - protein, 11 aa, Homo sapiens
RASQGISTYLA

SEQ ID NO: 662 - protein, 7 aa, Homo sapiens
AASTLQS

SEQ ID NO: 663 - protein, 8 aa, Homo sapiens
QKYNSAPS

SEQ ID NO: 664 - protein, 5 aa, Homo sapiens
SNAVS

SEQ ID NO: 665 - protein, 17 aa, Homo sapiens
GILGVFGSPSYAQKFQG

SEQ ID NO: 666 - protein, 11 aa, Homo sapiens
GPTYYYSYMDV

SEQ ID NO: 667 - protein, 11 aa, Homo sapiens
GGNNIGRNSVH

SEQ ID NO: 668 - protein, 5 aa, Homo sapiens
DNAIS

SEQ ID NO: 669 - protein, 11 aa, Homo sapiens
QVWHSSSDHYV

SEQ ID NO: 670 - protein, 5 aa, Homo sapiens
SYAIS

SEQ ID NO: 671 - protein, 17 aa, Homo sapiens
GIFGMFGTANYAQKFQG

SEQ ID NO: 672 - protein, 11 aa, Homo sapiens
SSGYYPQYFQD

SEQ ID NO: 673 - protein, 134 aa, Homo sapiens
ASTMDMRVLAQLLGLLLLWLRGARCDIQVTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVDIKRT

SEQ ID NO: 674 - protein, 134 aa, Homo sapiens
ASTMDMRVLAQLLGLLLLWLRGARCDIQMTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVEIKRT

SEQ ID NO: 675 - protein, 133 aa, Homo sapiens
ASTMDMRVLAQLLGLLLLWLRGARCDIQMTQSPSSLSASVGDRVTITCRTSQSISSYLNWYQQKPGKAPKLLIYAASSLQSGVPSRFSGSGSGTDFTLTISGLQPEDFATYYCQQSYSMPAFGQGTKLEIKRT

SEQ ID NO: 676 - protein, 140 aa, Homo sapiens
ASTMKHLWFFLLLVAAPSWVLSQVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQTLVTVS

SEQ ID NO: 677 - protein, 140 aa, Homo sapiens
ASTMELGLCWVFLVAILKGVQCEVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQTTVTVS

SEQ ID NO: 678 - protein, 140 aa, Homo sapiens; identical to SEQ ID NO: 676

SEQ ID NO: 679 - protein, 24 aa, Influenza A virus
MSLLTEVETPIKNGWECKCNDSSD

SEQ ID NO: 680 - protein, 23 aa, Influenza A virus
SLLTEVETPIRNEWGCRCNDSSD

SEQ ID NO: 681 - protein, 23 aa, Influenza A virus
SLLTEVETPIRSEWGCRCNDSGD

SEQ ID NO: 682 - protein, 23 aa, Influenza A virus
SLLTEVETPIRNEWECRCNGSSD

SEQ ID NO: 683 - protein, 23 aa, Influenza A virus
SLPTEVETPIRNEWGCRCNDSSD

SEQ ID NO: 684 - protein, 23 aa, Influenza A virus
SLLTEVETPIRNEWGCRCNGSSD

SEQ ID NO: 685 - protein, 23 aa, Influenza A virus
SLLTEVDTLTRNGWGCRCSDSSD

SEQ ID NO: 686 - protein, 23 aa, Influenza A virus
SLLTEVETPIRKEWGCNCSDSSD

SEQ ID NO: 687 - protein, 23 aa, Influenza A virus
SLLTEVETLIRNGWGCRCSDSSD

SEQ ID NO: 688 - protein, 23 aa, Influenza A virus
SLLTEVETLTKNGWGCRCSDSSD

SEQ ID NO: 689 - protein, 23 aa, Influenza A virus
SLLTEVETPIRSEWGCRYNDSSD

SEQ ID NO: 690 - protein, 23 aa, Influenza A virus
SLLTEVETPTRNGWECKCSDSSD

SEQ ID NO: 691 - protein, 23 aa, Influenza A virus
SLLTEVETHTRNGWECKCSDSSD

SEQ ID NO: 692 - protein, 23 aa, Influenza A virus
SLLTEVETHTRNGWECKCSDSSD

SEQ ID NO: 693 - protein, 23 aa, Influenza A virus
SLLTEVKTPTRNGWECKCSDSSD

SEQ ID NO: 694 - protein, 23 aa, Influenza A virus
SLLTEVETPTRDGWECKCSDSSD

SEQ ID NO: 695 - protein, 23 aa, Influenza A virus
SLLTEVETPTRNGWGCRCSDSSD

SEQ ID NO: 696 - protein, 23 aa, Influenza A virus
SLLTEVETPTRNGWECKCNDSSD

SEQ ID NO: 697 - protein, 23 aa, Influenza A virus
SLLTEVETPTRNGWECKCNDSSD

SEQ ID NO: 698 - protein, 23 aa, Influenza A virus
SLLTEVETPIRNEWGCKCNDSSD

SEQ ID NO: 699 - protein, 23 aa, Influenza A virus
SLLTEVETPTRNGWECRCNDSSD

SEQ ID NO: 700 - protein, 23 aa, Influenza A virus
SLLTEVETPTRNGWECRCNDSSD

SEQ ID NO: 701 - protein, 23 aa, Influenza A virus
SLLTEVETPTRNGWECRCNDSSD

SEQ ID NO: 702 - protein, 23 aa, Influenza A virus
SLLTEVETPIRKGWECNCSDSSD

SEQ ID NO: 703 - protein, 23 aa, Influenza A virus
SLLTGVETHTRNGWGCKCSDSSD

SEQ ID NO: 704 - protein, 23 aa, Influenza A virus
SLLPEVETHTRNGWGCRCSDSSD

SEQ ID NO: 705 - protein, 16 aa, Influenza A virus
LLTEVETPIRNEWGCR

SEQ ID NO: 706 - protein, 15 aa, Influenza A virus
LTEVETPIRNEWGCR

SEQ ID NO: 707 - protein, 12 aa, Influenza A virus
VETPIRNEWGCR

SEQ ID NO: 708 - protein, 17 aa, Influenza A virus
ETPIRNEWGCRCNDSSD

SEQ ID NO: 709 - protein, 16 aa, Influenza A virus
TPIRNEWGCRCNDSSD

SEQ ID NO: 710 - protein, 15 aa, Influenza A virus
PIRNEWGCRCNDSSD

SEQ ID NO: 711 - protein, 14 aa, Influenza A virus
IRNEWGCRCNDSSD

SEQ ID NO: 712 - protein, 13 aa, Influenza A virus
RNEWGCRCNDSSD

SEQ ID NO: 713 - protein, 12 aa, Influenza A virus
NEWGCRCNDSSD

SEQ ID NO: 714 - protein, 17 aa, Influenza A virus
SLLTEVETPIRNEWGCR

SEQ ID NO: 715 - protein, 16 aa, Influenza A virus
SLLTEVETPIRNEWGC

SEQ ID NO: 716 - protein, 15 aa, Influenza A virus
SLLTEVETPIRNEWG

SEQ ID NO: 717 - protein, 14 aa, Influenza A virus
SLLTEVETPIRNEW

SEQ ID NO: 718 - protein, 13 aa, Influenza A virus
SLLTEVETPIRNE

SEQ ID NO: 719 - protein, 12 aa, Influenza A virus
SLLTEVETPIRN

SEQ ID NO: 720 - protein, 11 aa, Influenza A virus
SLLTEVETPIR

SEQ ID NO: 721 - protein, 10 aa, Influenza A virus
SLLTEVETPI

SEQ ID NO: 722 - protein, 8 aa, Influenza A virus
SLLTEVET

SEQ ID NO: 723 - protein, 7 aa, Influenza A virus
SLLTEVE

SEQ ID NO: 724 - protein, 9 aa, Influenza A virus
SLLTEVETP

SEQ ID NO: 725 - protein, 12 aa, Homo sapiens
GSTYDFSSGLDY

SEQ ID NO: 726 - protein, 60 aa, Artificial Sequence
  Recombinant homotrimeric foldon HA protein
SGRLVPRGSPGSGYIPEAPRDGQAYVRKDGEWVLLSTFLGKPIPNPLLGLDSTGHHHHHH

SEQ ID NO: 727 - protein, 572 aa, Influenza A virus
DTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQSGRLVPRGSPGSGYIPEAPRDGQAYVRKDGEWVLLSTFLGKPIPNPLLGLDSTGHHHHHH

SEQ ID NO: 728 - protein, 571 aa, Influenza A virus
DTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQSGRLVPRGSPGSGYIPEAPRDGQAYVRKDGEWVLLSTFLGKPIPNPLLGLDSTGHHHHHH

SEQ ID NO: 729 - protein, 589 aa, Influenza A virus
MEARLLVLLCAFAATNADTICIGYHANNSTDTVDTVLEKNVTVTHSVNLLEDSHNGKLCKLKGIAPLQLGKCNIAGWLLGNPECDLLLTASSWSYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDGVKLESMGVYQSGRLVPRGSPGSGYIPEAPRDGQAYVRKDGEWVLLSTFLGKPIPNPLLGLDSTGHHHHHH

SEQ ID NO: 730 - protein, 570 aa, Influenza A virus
DQICIGYHANNSTEKVDTNLERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKEGSDYPVAKGSYNNTSGEQMLIIWGVHHPIDETEQRTLYQNVGTYVSVGTSTLNKRSTPEIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFGNLERRLENLNKRMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQSGRLVPRGSPGSGYIPEAPRDGQAYVRKDGEWVLLSTFLGKPIPNPLLGLDSTGHHHHHH

SEQ ID NO: 731 - protein, 570 aa, Influenza A virus
QKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSSCKRRSNNSFFSRLNWLTQLKFKYPALNVTMPNNEKFDKLYIWGVHHPVTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGSGRLVPRGSPGSGYIPEAPRDGQAYVRKDGEWVLLSTFLGKPIPNPLLGLDSTGHHHHHH

SEQ ID NO: 732 - protein, 571 aa, Influenza A virus
QNYTGNPVICLGHHAVSNGTMVKTLTDDQIEVVTAQELVESQHLPELCPSPLRLVDGQTCDIVNGALGSPGCDHLNGAEWDVFIERPTAVDTCYPFDVPDYQSLRSILANNGKFEFIAEEFQWNTVKQNGKSGACKRANVNDFFNRLNWLTKSDGNAYPLQNLTKVNNGDYARLYIWGVHHPSTDTEQTNLYKNNPGRVTVSTQTSQTSVVPNIGSRPWVRGLSSRISFYWTIVEPGDLIVFNTIGNLIAPRGHYKLNSQKKSTILNTAVPIGSCVSKCHTDKGSISTTKPFQNISRISIGDCPKYVKQGSLKLATGMRSILEKATRGLFGAIAGFIENGWQGLIDGWYGFRHQNAEGTGTAADLKSTQAAIDQINGKLNRLIGKPNEKYHQIEKEFEQVEGRIQDLEKYVEDTKIDLWSYNAELLVALENQHTIDVTDSEMNKLFERVRHQLRENAEDKGNGCFEIFHQCDNSCIESIRNGTYDHDIYRDEAINNRFQIQGVKLIQGYKDSGRLVPRGSPGSGYIPEAPRDGQAYVRKDGEWVLLSTFLGKPIPNPLLGLDSTGHHHHHH

SEQ ID NO: 733 - protein, 591 aa, Influenza A virus
MERTVLLLATVSLVKSDQICIGYHANNSTEQVDTIMEKNVTVTHAQDILERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGVHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSCYSADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQSGRLVPRGSPGSGYIPEAPRDGQAYVRKDGEWVLLSTFLGKPIPNPLLGLDSTGHHHHHH

SEQ ID NO: 734 - protein, 575 aa, Influenza A virus
DQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQSGRLVPRGSPGSGYIPEAPRDGQAYVRKDGEWVLLSTFLGKPIPNPLLGLDSTGHHHHHH

SEQ ID NO: 735 - protein, 575 aa, Influenza A virus
DQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQSGRLVPRGSPGSGYIPEAPRDGQAYVRKDGEWVLLSTFLGKPIPNPLLGLDSTGHHHHHH

SEQ ID NO: 736 - protein, 575 aa, Influenza A virus
DQICIGYHANNSTEQVDTIMEKNVTVTHAQDILEKTHNGKLCDLDGVKPLILRDCSVAGWLLGNPMCDEFLNVSEWSYIVEKINPANDLCYPGNFNNYEELKHLLSRINRFEKIQIIPKSSWPDHEASLGVSSACPYQGGPSFYRNVVWLIKKNNTYPTIKKSYHNTNQEDLLVLWGIHHPNDEAEQTRIYKNPTTYISVGTSTLNQRLVPKIATRSKVNGQSGRVEFFWTILKSNDTINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQSGRLVPRGSPGSGYIPEAPRDGQAYVRKDGEWVLLSTFLGKPIPNPLLGLDSTGHHHHHH

SEQ ID NO: 737 - protein, 574 aa, Influenza A virus
DHICIGYHANNSTEQVDTIMEKNVTVTHAQDILEKTHNGKLCDLNGVKPLILKDCSVAGWLLGNPMCDEFINVPEWSYIVEKANPANDLCYPGNFNDYEELKHLLSRINHFEKIQIIPKDSWSDHEASLGVSSACPYQGNSSFFRNVVWLIKKGNAYPTIKKSYNNTNQEDLLVLWGIHHPNDEAEQTRLYQNPTTYISIGTSTLNQRLVPKIATRSKVNGQSGRIDFFWTILKPNDAINFESNGNFIAPEYAYKIVKKGDSTIMKSEVEYGNCNTRCQTPMGAINSSMPFHNIHPLTIGECPKYVKSNKLVLATGLRNSPQRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQSGRLVPRGSPGSGYIPEAPRDGQAYVRKDGEWVLLSTFLGKPIPNPLLGLDSTGHHHHHH

SEQ ID NO: 738 - protein, 574 aa, Influenza A virus
DQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQSGRLVPRGSPGSGYIPEAPRDGQAYVRKDGEWVLLSTFLGKPIPNPLLGLDSTGHHHHHH

SEQ ID NO: 739 - protein, 571 aa, Influenza A virus
DQICIGYHANNSTEQVDTIMEKNVTVTHAQDILEKTHNGKLCNLDGVKPLILKDCSVAGWLLGNPMCDEFLNVSEWSYIVEKASPANGLCYPGDFNDYEELKHLLSRINHLKKIKIIPKSYWSNHEASSGVSAACSYLGEPSFFRNVVWLIKKNNTYPPIKVNYTNTNQEDLLVLWGIHHPNDEKEQIRIYQNPNTSISVGTSTLNQRLVPKIATRPKVNGQSGRMEFFWTILKPNDSINFDSNGNFIAPEYAYKIAKKGDSVIMKSELEYGNCNTKCQTPMGAINSSMPFHNIHPLTIGECPKYVKSNRLVLATGLRNAPQTETRGLFGAIAGFIEGGWQGMVDGWYGYHHSNEQGSGYAADKESTQKAIDGITNKVNSIIDKMNTQFEIVGREFNNLERRIENLNKKMEDGFLDVWTYNAELLVLMENERTLDFHDSNVKNLYEKVRLQLRDNAKELGNGCFEFYHKCDNECMESVRNGTYDYPQYSEEARLSREEISGVKMESMVTYQSGRLVPRGSPGSGYIPEAPRDGQAYVRKDGEWVLLSTFLGKPIPNPLLGLDSTGHHHHHH

SEQ ID NO: 740 - protein, 573 aa, Influenza A virus
DKICIGYHANNSTTQVDTILEKNVTVTHSVELLENQKEERFCKILNKAPLDLRGCTIEGWILGNPQCDLLLGDQSWSYIVERPTAQNGICYPGALNEVEELKALIGSGERVERFEMFPKSTWTGVDTSSGVTKACPYNSGSSFYRNLLWIIKTKSAAYPVIKGTYNNTGSQPILYFWGVHHPPDTNEQNTLYGSGDRYVRMGTESMNFAKSPEIAARPAVNGQRGRIDYYWSVLKPGETLNVESNGNLIAPWYAYKFVSTNNKGAIFKSNLPIENCDATCQTIAGVLRTNKTFQNVSPLWIGECPKYVKSESLRLATGLRNVPQIETRGLFGAIAGFIEGGWTGMIDGWYGYHHENSQGSGYAADKESTQKAIDGITNKVNSIIDKMNTQFEAVDHEFSNLERRIDNLNKRMEDGFLDVWTYNAELLVLLENERTLDLHDANVKNLYEKVKSQLRDNANDLGNGCFEFWHKCDNECIESVKNGTYDYPKYQDESKLNRQEIESVKLDNLGVYQSGRLVPRGSPGSGYIPEAPRDGQAYVRKDGEWVLLSTFLGKPIPNPLLGLDSTGHHHHHH

SEQ ID NO: 741 - protein, 567 aa, Influenza A virus
DKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVKQESLLLATGMKNVPEIPKRRRRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVKRQLRENAEEDGTGCFEIFHKCDDDCMASIRNNTYDHSKYREEAIQNRIQIDPVKLSSGYKDSGRLVPRGSPGSGYIPEAPRDGQAYVRKDGEWVLLSTFLGKPIPNPLLGLDSTGHHHHHH

SEQ ID NO: 742 - protein, 572 aa, Influenza A virus
DRICIGYQSNNSTDTVNTLIEQKVPVTQTMELVETEKHPAYCNTDLGAPLELRDCKIEAVIYGNPKCDIHLKDQGWSYIVERPSAPEGMCYPGSVENLEELRFVFSSAASYKRIRLFDYSRWNVTSSGTSKACNASTGGQSFYRSINWLTKKKPDTYDFNEGTYVNNEDGDIIFLWGIHHPPDTKEQTTLYKNANTLSSVTTNTINRSFQPNIGPRPLVRGQQGRMDYYWGILKRGETLKIRTNGNLIAPEFGYLLKGESHGRTIQNEDIPIGNCYTKCQTYAGAINSSKPFQNASRHYMGECPKYVKKASLRLAVGLRNTPSVEPRGLFGAIAGFIEGGWSGMIDGWYGFHHSNSEGTGMAADQKSTQEAIDKITNKVNNIVDKMNREFEVVNHEFSEVEKRINMINDKIDDQIEDLWAYNAELLVLLENQKTLDEHDSNVKNLFDEVKRRLSANAIDAGNGCFDILHKCDNECMETIKNGTYDHKEYEEEAKLERSKINGVKLEENTTYKSGRLVPRGSPGSGYIPEAPRDGQAYVRKDGEWVLLSTFLGKPIPNPLLGLDSTGHHHHHH

SEQ ID NO: 743 - protein, 565 aa, Influenza A virus
DKICIGYQSTNSTETVDTLTKTNVPVTQAKELLHTEHNGMLCATNLGHPLILDTCTIEGLIYGNPSCDLLLGGREWSYIVERPSAVNGMCYPGNVENLEELRLLFSSASSYQRVQIFPDTIWNVTYSGTSSACSNSFYRSMRWLTQKDNTYPVQDAQYTNNRGKSILFMWGINHPPTDTVQTNLYTRTDTTTSVTTEDINRAFKPVIGPRPLVNGLQGRIDYYWSVLKPGQTLRVRSNGNLIAPWYGHILSGESHGRILKSDLNSGNCVVQCQTERGGLNTTLPFHNVSKYAFGNCPKYVGVKSLKLAVGMRNVPARSSRGLFGAIAGFIEGGWPGLVAGWYGFQHSNDQGVGMAADRDSTQKAIDKITSKVNNIVDKMNKQYEIIDHEFSEIETRLNMINNKIDDQIQDIWAYNAELLVLLENQKTLDEHDANVNNLYNKVKRALGSNAMEDGKGCFELYHKCDDRCMETIRNGTYNRGKYKEESRLERQKIEGVKLESEGTYKSGRLVPRGSPGSGYIPEAPRDGQAYVRKDGEWVLLSTFLGKPIPNPLLGLDSTGHHHHHH

SEQ ID NO: 744 - protein, 583 aa, Influenza A virus
METISLITILLVVTASNADKICIGHQSTNSTETVDTLTETNVPVTHAKELLHTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVRVNSLKLAVGLRNVPARSSRGLFGAIAGFIEGGWPGLVAGWYGFQHSNDQGVGMAADRDSTQKAIDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYNRRKYREESRLERQKIEGVKLESEGTYKSGRLVPRGSPGSGYIPEAPRDGQAYVRKDGEWVLLSTFLGKPIPNPLLGLDSTGHHHHHH

SEQ ID NO: 745 - DNA, 372 bp, Homo sapiens
caggtgcaactgcaggagtcgggcccaggactggtgaagccctcggagaccctgtccctcacttgcgctgtctctggtgtctccatcagcaatattgatttctactggggctggatccgccagcccccagggaaggggctagaatggattggcaatatctattatacggggatcaccttctacaacccgtccctcagcagtcgagtcgccatatccattgacacctccaagaaccagttctccctgactctgacttctgtgaccgccgcagacacggctatgtattactgtgcgagacattacggtgactccgaggcaataaacgatgcctttgacatctggggccaagggacaatgctcaccgtctcgagc

SEQ ID NO: 746 - protein, 124 aa, Homo sapiens
QVQLQESGPGLVKPSETLSLTCAVSGVSISNIDFYWGWIRQPPGKGLEWIGNIYYTGITFYNPSLSSRVAISIDTSKNQFSLTLTSVTAADTAMYYCARHYGDSEAINDAFDIWGQGTMLTVSS

SEQ ID NO: 747 - protein, 7 aa, Homo sapiens
NIDFYWG

SEQ ID NO: 748 - protein, 16 aa, Homo sapiens
NIYYTGITFYNPSLSS

SEQ ID NO: 749 - protein, 14 aa, Homo sapiens
HYGDSEAINDAFDI

SEQ ID NO: 750 - protein, 6 aa, Homo sapiens
GVSISN

SEQ ID NO: 751 - protein, 9 aa, Homo sapiens
NIYYTGITF

SEQ ID NO: 752 - DNA, 324 bp, Homo sapiens
gagatagtgatgacgcagtctccagccaccctgtctgtgtctccaggggaaagagccaccctctcctgcagggccagtcagagtgttggcaatagtttagcctggtaccagcagagacctggccaggctcccaggctcctcatctacggtgcatccaccagggccactggtatcccacccaggttcagtggcagtgggtctgggacagaattcactctcaccatcagcagcctgcagactgaagattttgcagtttattactgtcaacaatatattaactggcgtccgctcagttttggcggagggaccaaggtggagatcaaa

SEQ ID NO: 753 - protein, 108 aa, Homo sapiens
EIVMTQSPATLSVSPGERATLSCRASQSVGNSLAWYQQRPGQAPRLLIYGASTRATGIPPRFSGSGSGTEFTLTISSLQTEDFAVYYCQQYINWRPLSFGGGTKVEIK

SEQ ID NO: 754 - protein, 11 aa, Homo sapiens
RASQSVGNSLA

SEQ ID NO: 755 - protein, 7 aa, Homo sapiens
GASTRAT

SEQ ID NO: 756 - protein, 10 aa, Homo sapiens
QQYINWRPLS

SEQ ID NO: 757 - protein, 13 aa, Influenza A virus
TGSSSMNIGNYVA

SEQ ID NO: 758 - DNA, 366 bp, Homo sapiens
gaagtgcagttggtgcagtctggaggaggcttggtccagcctggggggtccctgagactcgcctgtgtagtctctgggttcaccgtcaccagcaattatataacttgggtccgccaggctccagggaaggggctggagtgggtctcagttatttatagtcatggtcgcgcatattattcagcctccgtgaatggccgattcaccatctccagacacacttccaagaacacagtttatcttgaaatgaacagcctgagacctgaggacacggccgtctattactgtgcgggcgggggcctagtcggtggctacgacgaatatttctttgactattggggccagggaaccctggccaccgtctcctca

SEQ ID NO: 759 - protein, 122 aa, Homo sapiens
EVQLVQSGGGLVQPGGSLRLACVVSGFTVTSNYITWVRQAPGKGLEWVSVIYSHGRAYYSASVNGRFTISRHTSKNTVYLEMNSLRPEDTAVYYCAGGGLVGGYDEYFFDYWGQGTLATVSS

SEQ ID NO: 760 - protein, 5 aa, Homo sapiens
SNYIT

SEQ ID NO: 761 - protein, 16 aa, Homo sapiens
VIYSHGRAYYSASVNG

SEQ ID NO: 762 - protein, 14 aa, Homo sapiens
GGLVGGYDEYFFDY

SEQ ID NO: 763 - protein, 6 aa, Homo sapiens
GFTVTS

SEQ ID NO: 764 - protein, 9 aa, Homo sapiens
VIYSHGRAY

SEQ ID NO: 765 - DNA, 324 bp, Homo sapiens
gaaactgtcttgacgcaatctccaggcaccttgtctttgactccaggggaaagagccaccctctcctgcagagtcggtcagagtgttagcggcagccacttagcctggtaccaacagaaacctggccaggctcccaggctcctcatctatggtgcatccagcagggccactggcatcccagacaggttcggtggcagtgtgtctgggacagacttcactctcaccatcagcagactggagcctgaagattctgcagtttattactgtcagcagtatggtgactcacgatacacttttggccaggggaccaagctggagatcaaa

SEQ ID NO: 766 - protein, 108 aa, Homo sapiens
ETVLTQSPGTLSLTPGERATLSCRVGQSVSGSHLAWYQQKPGQAPRLLIYGASSRATGIPDRFGGSVSGTDFTLTISRLEPEDSAVYYCQQYGDSRYTFGQGTKLEIK

SEQ ID NO: 767 - protein, 12 aa, Homo sapiens
RVGQSVSGSHLA

SEQ ID NO: 768 - protein, 7 aa, Homo sapiens
GASSRAT

SEQ ID NO: 769 - protein, 9 aa, Homo sapiens
QQYGDSRYT

SEQ ID NO: 770 - DNA, 381 bp, Homo sapiens
caggtgcagctacagcagtggggcgcaggacttttgaaaccttcggagaccctgtccctcacctgcactgtgtctggggggtccctcactgattactcttggaactggatccgccagcccccagggaaggggctggagtggatcggtgacacccttcataatggctacaccaactacaacccgtccctcaggggtcgagtttccatctcaatagacacgtccaagaaccaggtctcactcaggctgacctctgtgaccgccgcggacacggctctttattactgtgcgagaggctcaggtggatatggtggcttcgattattttggcaagctccggacatgggacttctggggccagggaacgctggtcaccgtctcctca

SEQ ID NO: 771 - protein, 127 aa, Homo sapiens
QVQLQQWGAGLLKPSETLSLTCTVSGGSLTDYSWNWIRQPPGKGLEWIGDTLHNGYTNYNPSLRGRVSISIDTSKNQVSLRLTSVTAADTALYYCARGSGGYGGFDYFGKLRTWDFWGQGTLVTVSS

SEQ ID NO: 772 - protein, 5 aa, Homo sapiens
DYSWN

SEQ ID NO: 773 - protein, 16 aa, Homo sapiens
DTLHNGYTNYNPSLRG

SEQ ID NO: 774 - protein, 19 aa, Homo sapiens
GSGGYGGFDYFGKLRTWDF

SEQ ID NO: 775 - protein, 6 aa, Homo sapiens
GGSLTD

SEQ ID NO: 776 - protein, 9 aa, Homo sapiens
DTLHNGYTN

SEQ ID NO: 777 - DNA, 321 bp, Homo sapiens
gacattcagttgacccagtctccatcctccctgtctgcatctgtgggagacagagtcaccatcacttgccgggcaagtcagggcattagaaatgatttaggctggtatcagcaaaaaccagggaacgcccctaagcgcctgatctttggtgcatccagtttgcaaagtggggtcccatcaaggttcagcggcagtggatctgggacagagttcactctcacaatcagcagcctgcagcctgaggactttgcaacttattactgtctacagcataatagttacccgtacacttttggccaggggaccaagctggagatcaag

SEQ ID NO: 778 - protein, 107 aa, Homo sapiens
DIQLTQSPSSLSASVGDRVTITCRASQGIRNDLGWYQQKPGNAPKRLIFGASSLQSGVPSRFSGSGSGTEFTLTISSLQPEDFATYYCLQHNSYPYTFGQGTKLEIK

SEQ ID NO: 779 - protein, 11 aa, Homo sapiens
RASQGIRNDLG

SEQ ID NO: 780 - protein, 7 aa, Homo sapiens
GASSLQS

SEQ ID NO: 781 - protein, 9 aa, Homo sapiens
LQHNSYPYT

SEQ ID NO: 782 - DNA, 354 bp, Homo sapiens
caggtgcaactggtgcagtctggggctgaggtgaagaagcctgggtcctcggtgaaggtctcctgcaaggcttctggaggcagcttcagcaactatgccttcagctgggtgcgacaggcccctggacaagggcttgagtggatgggagggaccatccctctacttggtacaacaaactacgcacagaagttccagggcagagtcacgatttccgcggaccaattcacgagcacagcctacatggagctgggcagcctgagatctgaagacacggccgtgtattactgtacgagacggaaaatgactacggcttttgactcctggggccagggaaccctggtcaccgtctcctca

SEQ ID NO: 783 - protein, 118 aa, Homo sapiens
QVQLVQSGAEVKKPGSSVKVSCKASGGSFSNYAFSWVRQAPGQGLEWMGGTIPLLGTTNYAQKFQGRVTISADQFTSTAYMELGSLRSEDTAVYYCTRRKMTTAFDSWGQGTLVTVSS

SEQ ID NO: 784 - protein, 5 aa, Homo sapiens
NYAFS

SEQ ID NO: 785 - protein, 17 aa, Homo sapiens
GTIPLLGTTNYAQKFQG

SEQ ID NO: 786 - protein, 9 aa, Homo sapiens
RKMTTAFDS

SEQ ID NO: 787 - protein, 6 aa, Homo sapiens
GGSFSN

SEQ ID NO: 788 - protein, 10 aa, Homo sapiens
GTIPLLGTTN

SEQ ID NO: 789 - DNA, 354 bp, Homo sapiens
cagcctgttctgactcagccaccttctgcatcagcctccctgggagcctcggtcacactcacctgcaccctgagcagcgcctacagtaattataaagtggactggtaccagcagagaccagggaagggcccccgctttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcgtgtccccttacgtattcggcggagggaccaagctgaccgttcta

SEQ ID NO: 790 - protein, 118 aa, Homo sapiens
QPVLTQPPSASASLGASVTLTCTLSSAYSNYKVDWYQQRPGKGPRFVMRVGTGGIVGSKGDGIPDRFSVLGSGLNRYLTIKNIQEEDESDYHCGADHGSGSNFVSPYVFGGGTKLTVL

SEQ ID NO: 791 - protein, 12 aa, Homo sapiens
TLSSAYSNYKVD

SEQ ID NO: 792 - protein, 12 aa, Homo sapiens
VGTGGIVGSKGD

SEQ ID NO: 793 - protein, 15 aa, Homo sapiens
GADHGSGSNFVSPYV

SEQ ID NO: 794 - DNA, 369 bp, Homo sapiens
caggtgcagctggcgcagtctggggctgaggtgaagaggcctgggtcctcggtgaaagtctcatgcacggcttctggaggcatcttcaggaagaatgcaatcagctgggtgcgacaggcccctggacaaggccttgagtggatgggagggatcatcgcagtctttaacacagcaaattacgcgcagaagtttcagggcagagtcaaaattaccgcagacgaatccgggaatacagcctacatggagctgagcagcctgagatctgacgacacggccgtgtattactgtgcgagtcacccaaaatatttctatggttcggggagttatccggacttctggggccagggaaccctggtcaccgtctcgagc

SEQ ID NO: 795 - protein, 123 aa, Homo sapiens
QVQLAQSGAEVKRPGSSVKVSCTASGGIFRKNAISWVRQAPGQGLEWMGGIIAVFNTANYAQKFQGRVKITADESGNTAYMELSSLRSDDTAVYYCASHPKYFYGSGSYPDFWGQGTLVTVSS

SEQ ID NO: 796 - protein, 5 aa, Homo sapiens
KNAIS

SEQ ID NO: 797 - protein, 17 aa, Homo sapiens
GIIAVFNTANYAQKFQG

SEQ ID NO: 798 - protein, 14 aa, Homo sapiens
HPKYFYGSGSYPDF

SEQ ID NO: 799 - protein, 6 aa, Homo sapiens
GGIFRK

SEQ ID NO: 800 - protein, 10 aa, Homo sapiens
GIIAVFNTAN

SEQ ID NO: 801 - DNA, 330 bp, Homo sapiens
caatctgccctgactcagcctcgctcagtgtccgggtctcctggacagtcagtcaccatctcctgcactggaagcagcagtgatgttggtgcttctaactctgtctcctggtaccaacaacacccaggcaaagcccccaaactcgttatttatgatgtcactgagcgaccctcaggggtccctcatcgcttctctggctccaagtctggcaacacggcctccctgaccgtctctgggctccagcctgaggacgaggctgattatttctgctgcgcatatggaggcaaatatcttgtggtcttcggcggagggaccaaggtgaccgtcctc

SEQ ID NO: 802 - protein, 110 aa, Homo sapiens
QSALTQPRSVSGSPGQSVTISCTGSSSDVGASNSVSWYQQHPGKAPKLVIYDVTERPSGVPHRFSGSKSGNTASLTVSGLQPEDEADYFCCAYGGKYLVVFGGGTKVTVL

SEQ ID NO: 803 - protein, 14 aa, Homo sapiens
TGSSSDVGASNSVS

SEQ ID NO: 804 - protein, 7 aa, Homo sapiens
DVTERPS

SEQ ID NO: 805 - protein, 10 aa, Homo sapiens
CAYGGKYLVV

SEQ ID NO: 806 - DNA, 387 bp, Homo sapiens
gaggtgctgatggtggagtctgggggaggcttggtccagcctggggggtccgtgagactctcctgtgtagcctctggattcagtttcagtagtcattggatgacctgggtccgccaggctccagggaaggggctggagtgggtggccaacatagaggacgatggaggtgacaagtactatgtggactctgtgaagggccgattcattatctccagagacaacgccaagaattcagtgtatctgcaaatgaacagcctaagagccgaggacacggctgtgtatttctgtgcgagaggttcggggagctctgatagaagtgattatgacccccactactactactacttggacgtctggggcaaaggggccacggtcaccgtctcctca

SEQ ID NO: 807 - protein, 129 aa, Homo sapiens
EVLMVESGGGLVQPGGSVRLSCVASGFSFSSHWMTWVRQAPGKGLEWVANIEDDGGDKYYVDSVKGRFIISRDNAKNSVYLQMNSLRAEDTAVYFCARGSGSSDRSDYDPHYYYYLDVWGKGATVTVSS

SEQ ID NO: 808 - protein, 5 aa, Homo sapiens
SHWMT

SEQ ID NO: 809 - protein, 17 aa, Homo sapiens
NIEDDGGDKYYVDSVKG

SEQ ID NO: 810 - protein, 20 aa, Homo sapiens
GSGSSDRSDYDPHYYYYLDV

SEQ ID NO: 811 - protein, 6 aa, Homo sapiens
GFSFSS

SEQ ID NO: 812 - protein, 10 aa, Homo sapiens
NIEDDGGDKY

SEQ ID NO: 813 - DNA, 321 bp, Homo sapiens
gacatccagctgacccagtctccatcttccctgtctgcatctgtaggagacagagtcaccatcacttgccgggcaagtcagagcattagtaggtatttaaattggtatcagcaaaaaccagggaaagcccctaagctcctgctgtttgctgcttctactttgctagatggggtcccatcaagattcagtggcagtggatctgggacagatttcactctcaccatcagcagtctgcaacctgaagattttgcaacttactactgtcaacggaatcacagtccctcgtggacgttcggccaagggaccagggtggaaatcaaa

SEQ ID NO: 814 - protein, 107 aa, Homo sapiens
DIQLTQSPSSLSASVGDRVTITCRASQSISRYLNWYQQKPGKAPKLLLFAASTLLDGVPSRFSGSGSGTDFTLTISSLQPEDFATYYCQRNHSPSWTFGQGTRVEIK

SEQ ID NO: 815 - protein, 11 aa, Homo sapiens
RASQSISRYLN

SEQ ID NO: 816 - protein, 7 aa, Homo sapiens
AASTLLD

SEQ ID NO: 817 - protein, 9 aa, Homo sapiens
QRNHSPSWT

SEQ ID NO: 818 - DNA, 372 bp, Homo sapiens
caggtgcagctgcaagagtcgggcccgggactggtgaagccttcggagaccctgtccctcaactgcgctgtctctggaggctccatcagtaattactactggagctggatccggcagccccccgggaagggactggagtggattggctatatctcttacaatgggaggcccaagtacaacccctccctcacgagtcgagtcaccatatccgtcgacacgtccaaggaccagttctccctggagctgcgctctgtgaccgctgcggacacggccctttattactgtgcgagagaaacgcggttcggggagttattatctccctatgatgcttttgaaatctggggccaagggacaatggtcaccgtctcctca

SEQ ID NO: 819 - protein, 124 aa, Homo sapiens
QVQLQESGPGLVKPSETLSLNCAVSGGSISNYYWSWIRQPPGKGLEWIGYISYNGRPKYNPSLTSRVTISVDTSKDQFSLELRSVTAADTALYYCARETRFGELLSPYDAFEIWGQGTMVTVSS

SEQ ID NO: 820 - protein, 5 aa, Homo sapiens
NYYWS

SEQ ID NO: 821 - protein, 16 aa, Homo sapiens
YISYNGRPKYNPSLTS

SEQ ID NO: 822 - protein, 16 aa, Homo sapiens
ETRFGELLSPYDAFEI

SEQ ID NO: 823 - protein, 9 aa, Homo sapiens
YISYNGRPK

SEQ ID NO: 824 - protein, 6 aa, Homo sapiens
GGSISN

SEQ ID NO: 825 - DNA, 321 bp, Homo sapiens
gacatccagatgacccagtctccatcctccctgtctgcatctgtaggagacagagtcaccatgacttgccgggcaagtcagaacattagaagctatttaaattggtatcagcagagaccagggacagcccctaaactcctgatctatgctgcatccactttacacagtggggtcccatcaaggttcagtggcggtgggtctgggacagatttcactctcaccatcaataatctgcaacctgaagattttgcatcttactactgtcaacagagttacgataaccctcagacgttcggccaagggaccaaggtggaaatcaaa

SEQ ID NO: 826 - protein, 107 aa, Homo sapiens
DIQMTQSPSSLSASVGDRVTMTCRASQNIRSYLNWYQQRPGTAPKLLIYAASTLHSGVPSRFSGGGSGTDFTLTINNLQPEDFASYYCQQSYDNPQTFGQGTKVEIK

SEQ ID NO: 827 - protein, 11 aa, Homo sapiens
RASQNIRSYLN

SEQ ID NO: 828 - protein, 7 aa, Homo sapiens
AASTLHS

SEQ ID NO: 829 - protein, 9 aa, Homo sapiens
QQSYDNPQT

SEQ ID NO: 830 - DNA, 399 bp, Homo sapiens
caggtgcagctggtgcagtctgggtctgaggtgaagaagcctggggcctcagtgaaggtctcctgcaaggcttctggatacaccttcaccaattatgacatcaactggattcgacaggcccctggtcaaggacttgagtggatgggctggataaatcccaacagtggaaccacgggctctgcacagaggttccagggcagagtcaccataaccgtggacacctccataaccacagtctacatggaactgagcagcctgagatctgacgacacggccatttactactgcgcgagaggccgtgagctcctccggcttcaacattttttgactgactcccagtccgagaggagggactgcttcgacccctggggccagggaaccctggtcaccgtctcctca

SEQ ID NO: 831 - protein, 133 aa, Homo sapiens
QVQLVQSGSEVKKPGASVKVSCKASGYTFTNYDINWIRQAPGQGLEWMGWINPNSGTTGSAQRFQGRVTITVDTSITTVYMELSSLRSDDTAIYYCARGRELLRLQHFLTDSQSERRDCFDPWGQGTLVTVSS

SEQ ID NO: 832 - protein, 5 aa, Homo sapiens
NYDIN

SEQ ID NO: 833 - protein, 17 aa, Homo sapiens
WINPNSGTTGSAQRFQG

SEQ ID NO: 834 - protein, 24 aa, Homo sapiens
GRELLRLQHFLTDSQSERRDCFDP

SEQ ID NO: 835 - protein, 6 aa, Homo sapiens
GYTFTN

SEQ ID NO: 836 - protein, 10 aa, Homo sapiens
WINPNSGTTG

SEQ ID NO: 837 - DNA, 321 bp, Homo sapiens
gatatccagatgacccagtctccttcctccctgtctgcatctgtaggagacagagtcaccatcacttgccgggcaaatcaagacattggcatttatttaaattggtatcaacagaatccagggaaagtccctaaactcctgctccatggtgcgtccagtttgcagggcggggtcccatcaaggttcagtgccagtggatctgggacagatttcactctcaccattcacagtctacaacctgaagatttagcaacctactactgtcaacagagtcgccgtctaccgtacacttttggccaggggaccagggtggaactcaaa

SEQ ID NO: 838 - protein, 107 aa, Homo sapiens
DIQMTQSPSSLSASVGDRVTITCRANQDIGIYLNWYQQNPGKVPKLLLHGASSLQGGVPSRFSASGSGTDFTLTIHSLQPEDLATYYCQQSRRLPYTFGQGTRVELK

SEQ ID NO: 839 - protein, 11 aa, Homo sapiens
RANQDIGIYLN

SEQ ID NO: 840 - protein, 7 aa, Homo sapiens
GASSLQG

SEQ ID NO: 841 - protein, 9 aa, Homo sapiens
QQSRRLPYT

SEQ ID NO: 842 - DNA, 360 bp, Homo sapiens
cagatcaccttgagggagtctggtcctacgctggtgaaacccacacagaccctcacgctgacctgcaccttctctgggttttcactcagcactaatggagtgaatgtgggctggatccgtcagcccccaggaaaggccctggagtggcttgcactcatttactgggatgatgataagcgctacagtccgtctctgaagagaaggctcaccatcaccaaggacacctccaaaaaccaagtggtccttacactgaccaacatggaccctgtagatacagccacatattactgtgcacacagacccgacttctatggtgacttcgagtactggggcccgggaaccctggtcaccgtctcctca

SEQ ID NO: 843 - protein, 120 aa, Homo sapiens
QITLRESGPTLVKPTQTLTLTCTFSGFSLSTNGVNVGWIRQPPGKALEWLALIYWDDDKRYSPSLKRRLTITKDTSKNQVVLTLTNMDPVDTATYYCAHRPDFYGDFEYWGPGTLVTVSS

SEQ ID NO: 844 - protein, 7 aa, Homo sapiens
TNGVNVG

SEQ ID NO: 845 - protein, 16 aa, Homo sapiens
LIYWDDDKRYSPSLKR

SEQ ID NO: 846 - protein, 10 aa, Homo sapiens
RPDFYGDFEY

SEQ ID NO: 847 - protein, 8 aa, Homo sapiens
GFSLSTNG

SEQ ID NO: 848 - protein, 9 aa, Homo sapiens
LIYWDDDKR

SEQ ID NO: 849 - DNA, 330 bp, Homo sapiens
cagtctgcactgactcagcctgcctccgtgtctgggtctcccggacagtcgatcaccatctcctgcactggaagcagcagtgacattggtggttataactatgtctcctggtaccaacaacacccaggcaaggcccccaaactcatgatttacgatgtcaataatcggccctcaggggtttctaatcgcttctctggctccaagtctggcaacacggcctccctgactatctctgggctccagactgacgacgaggctgattattactgcggctcatatacaggcagtcctcattatgtcttcggaactgggaccaaggtcaccgtccta

SEQ ID NO: 850 - protein, 110 aa, Homo sapiens
QSALTQPASVSGSPGQSITISCTGSSSDIGGYNYVSWYQQHPGKAPKLMIYDVNNRPSGVSNRFSGSKSGNTASLTISGLQTDDEADYYCGSYTGSPHYVFGTGTKVTVL

SEQ ID NO: 851 - protein, 14 aa, Homo sapiens
TGSSSDIGGYNYVS

SEQ ID NO: 852 - protein, 7 aa, Homo sapiens
DVNNRPS

SEQ ID NO: 853 - protein, 10 aa, Homo sapiens
GSYTGSPHYV

SEQ ID NO: 854 - DNA, 363 bp, Homo sapiens
caggtccaactggtgcaatctggggctgaggtgaggaagcctgggtcctcggtgaaggtctcctgcaaggcttctggaggccccttcatgagttatgctatcggctgggtgcgacaggcccctggacaagggcttgagtggatgggagggatcaaccctgtgtttggtagaccgcactacgcacagaagttccagggcagagtcaccatcgccacggacgactccacgaagacatcgtacatggaactgagtagcctgacgtctgaggacacgggcatgtattactgtgcgagtaggtatagtaggtcgtccccagggacctttgagtcctggggccagggaaccctggtcaccgtctcgagc

SEQ ID NO: 855 - protein, 121 aa, Homo sapiens
QVQLVQSGAEVRKPGSSVKVSCKASGGPFMSYAIGWVRQAPGQGLEWMGGINPVFGRPHYAQKFQGRVTIATDDSTKTSYMELSSLTSEDTGMYYCASRYSRSSPGTFESWGQGTLVTVSS

SEQ ID NO: 856 - protein, 5 aa, Homo sapiens
SYAIG

SEQ ID NO: 857 - protein, 17 aa, Homo sapiens
GINPVFGRPHYAQKFQG

SEQ ID NO: 858 - protein, 12 aa, Homo sapiens
RYSRSSPGTFES

SEQ ID NO: 859 - protein, 6 aa, Homo sapiens
GGPFMS

SEQ ID NO: 860 - protein, 10 aa, Homo sapiens
GINPVFGRPH

SEQ ID NO: 861 - DNA, 327 bp, Homo sapiens
gaaatagtgatgacgcagtttccagccaccctgtctgtgtctcccggggaacgagtcaccctctcctgtagggccagtcagagtgttagcaacaatttagcctggtaccagcaaaaacctggccagcctcccaggctcctcatctatgatgcatctaccagggccacgggtgtcccagccaagttcagtggcactgggtctggcacagagttcactctcagcatcagcagcctgcagtccgaagattttgcagtttattactgtcagcagtatcacaactggcctccctcgtacagttttggcctggggaccaagctggagatcaaa

SEQ ID NO: 862 - protein, 109 aa, Homo sapiens
EIVMTQFPATLSVSPGERVTLSCRASQSVSNNLAWYQQKPGQPPRLLIYDASTRATGVPAKFSGTGSGTEFTLSISSLQSEDFAVYYCQQYHNWPPSYSFGLGTKLEIK

SEQ ID NO: 863 - protein, 11 aa, Homo sapiens
RASQSVSNNLA

SEQ ID NO: 864 - protein, 7 aa, Homo sapiens
DASTRAT

SEQ ID NO: 865 - protein, 11 aa, Homo sapiens
QQYHNWPPSYS

SEQ ID NO: 866 - DNA, 387 bp, Homo sapiens
gaggtgcagctggtggagtctgggggagacttggtacagccagggcggtccctgaaactctcctgcacaggttctggattcacctttggtgattatggtgtgacctgggtccgccaggctccagggaaggggctggagtgggtaggtttcattagaaccagaccttggggtgggacagcagataccgccgcgtctgtgaaaggcagattcactatttcaagagatgattccaaaagtctcgcctatctgcaaatgaacagcctgaaaaccgaggacacagccgtgtattactgttgtagagatgcccctccaaatgtggaagtggcttctatgaccaactggtacttcgatctctggggccgtggcaccctggtcaccgtctcctca

SEQ ID NO: 867 - protein, 129 aa, Homo sapiens
EVQLVESGGDLVQPGRSLKLSCTGSGFTFGDYGVTWVRQAPGKGLEWVGFIRTRPWGGTADTAASVKGRFTISRDDSKSLAYLQMNSLKTEDTAVYYCCRDAPPNVEVASMTNWYFDLWGRGTLVTVSS

SEQ ID NO: 868 - protein, 5 aa, Homo sapiens
DYGVT

SEQ ID NO: 869 - protein, 19 aa, Homo sapiens
FIRTRPWGGTADTAASVKG

SEQ ID NO: 870 - protein, 18 aa, Homo sapiens
DAPPNVEVASMTNWYFDL

SEQ ID NO: 871 - protein, 6 aa, Homo sapiens
GFTFGD

SEQ ID NO: 872 - protein, 12 aa, Homo sapiens
FIRTRPWGGTAD

SEQ ID NO: 873 - DNA, 318 bp, Homo sapiens
gacatccagctgacccagtctccatcctccctgtctgcatctgtgggagacagagtcaccatcacttgccgggcgagtcagggcattctcaattgtttagcctggtatcagcagaaaccggggaaagttcctaacctcctgatgtatgctgcatccacattgcagtcaggggtcccatctcggttcagcggcagtggatttgggacagatttcactctcaccatcagcagcctgcagcctgaagatgttgcaacttattactgtcaaacgtatggcggtgtctctactttcggcggagggaccaaggtggagatcaga

SEQ ID NO: 874 - protein, 106 aa, Homo sapiens
DIQLTQSPSSLSASVGDRVTITCRASQGILNCLAWYQQKPGKVPNLLMYAASTLQSGVPSRFSGSGFGTDFTLTISSLQPEDVATYYCQTYGGVSTFGGGTKVEIR

SEQ ID NO: 875 - protein, 11 aa, Homo sapiens
RASQGILNCLA

SEQ ID NO: 876 - protein, 7 aa, Homo sapiens
AASTLQS

SEQ ID NO: 877 - protein, 8 aa, Homo sapiens
QTYGGVST

SEQ ID NO: 878 - DNA, 372 bp, Homo sapiens
caggtgcagctgcaggagtcgggcccaggactggtgaagccttcggagaccttgtccctcacctgcactgtctctggtggctccgtcagcagtgagacttactactggagctggatccggcagcccccagggaagggactagagtggattggatatatctattacattgggaacaccgactacaggccctccctcaagagtcgagtcaccatatcactggacacgtccaagaaccagttctccctgaagctgagctctgtgaccgctgcggacacggccgtttattactgtgcgagaggcgcttattatgatagtagtggttacccggctttttatatctggggccaagggacaatggtcaccgtctcctca

SEQ ID NO: 879 - protein, 124 aa, Homo sapiens
QVQLQESGPGLVKPSETLSLTCTVSGGSVSSETYYWSWIRQPPGKGLEWIGYIYYIGNTDYRPSLKSRVTISLDTSKNQFSLKLSSVTAADTAVYYCARGAYYDSSGYPAFYIWGQGTMVTVSS

SEQ ID NO: 880 - protein, 7 aa, Homo sapiens
SETYYWS

SEQ ID NO: 881 - protein, 16 aa, Homo sapiens
YIYYIGNTDYRPSLKS

SEQ ID NO: 882 - protein, 14 aa, Homo sapiens
GAYYDSSGYPAFYI

SEQ ID NO: 883 - protein, 8 aa, Homo sapiens
GGSVSSET

SEQ ID NO: 884 - protein, 9 aa, Homo sapiens
YIYYIGNTD

SEQ ID NO: 885 - DNA, 336 bp, Homo sapiens
cagtctgtgctgacgcagccgccctcagtgtctggggccccagggcagagggtcaccatctcctgcactgggagcagctccaacatcgggtcagattatgatgtgcactggtacaagcaacttccaggaacagcccccaaactcctcatctttggtaacagcaatcggccctcaggggtccctgaccgattctctggctccaagtctggcacctcagcctccctggccatcactgggctccaggctgaggatgaggctgattattactgccaatcctatgacagcagcctgagtggttttcatgtcttcggaagtgggaccaaggtcaccgtccta

SEQ ID NO: 886 - protein, 112 aa, Homo sapiens
QSVLTQPPSVSGAPGQRVTISCTGSSSNIGSDYDVHWYKQLPGTAPKLLIFGNSNRPSGVPDRFSGSKSGTSASLAITGLQAEDEADYYCQSYDSSLSGFHVFGSGTKVTVL

SEQ ID NO: 887 - protein, 14 aa, Homo sapiens
TGSSSNIGSDYDVH

SEQ ID NO: 888 - protein, 7 aa, Homo sapiens
GNSNRPS

SEQ ID NO: 889 - protein, 12 aa, Homo sapiens
QSYDSSLSGFHV

SEQ ID NO: 890 - DNA, 354 bp, Homo sapiens
caggtgcagctggtgcagtctggggctgacgtgaagaagcctgggtcctcggtgacggtctcctgcaaggcttctggaggcagcttcagcaactatggaatcaactgggtgcgacaggcccctggacaagggcttgagtggatggggggaatcatccctctcattaatgcaccgaactacgcaccgaagttccagggcagagtgacgattaccgcggacatgttctcgaatatagtctccttgcagttgaccagcctgagaactgacgacacggccgtgtattattgtgcgagacgaaaaatgactacggctattgactattggggccagggaaccctggtcaccgtctcctca

SEQ ID NO: 891 - protein, 118 aa, Homo sapiens
QVQLVQSGADVKKPGSSVTVSCKASGGSFSNYGINWVRQAPGQGLEWMGGIIPLINAPNYAPKFQGRVTITADMFSNIVSLQLTSLRTDDTAVYYCARRKMTTAIDYWGQGTLVTVSS

SEQ ID NO: 892 - protein, 5 aa, Homo sapiens
NYGIN

SEQ ID NO: 893 - protein, 17 aa, Homo sapiens
GIIPLINAPNYAPKFQG

SEQ ID NO: 894 - protein, 9 aa, Homo sapiens
RKMTTAIDY

SEQ ID NO: 895 - protein, 10 aa, Homo sapiens
GIIPLINAPN

SEQ ID NO: 896 - DNA, 354 bp, Homo sapiens
cagcctgtgttgagtcagccaccttctgcatcggcctccctgggagcctccgtcacactcacctgcaccctgagtagcggcttcgataattatcaagtggcctggtaccagcagagaccagggaagggcccccgctttgtgatgcgggtgggcaatggtgggaatgtggcttccaagggggatggcattcctgatcgtttctcagtctcgggctcaggcctgaatcggtacctgaccatcaagaacatccaggaagacgatgagagtgactattattgtggggcagaccatggcagtgggaacaacttcgtgtccccttatgtgtttggcggagggaccaagctgaccgttcta

SEQ ID NO: 897 - protein, 118 aa, Homo sapiens
QPVLSQPPSASASLGASVTLTCTLSSGFDNYQVAWYQQRPGKGPRFVMRVGNGGNVASKGDGIPDRFSVSGSGLNRYLTIKNIQEDDESDYYCGADHGSGNNFVSPYVFGGGTKLTVL

SEQ ID NO: 898 - protein, 12 aa, Homo sapiens
TLSSGFDNYQVA

SEQ ID NO: 899 - protein, 12 aa, Homo sapiens
VGNGGNVASKGD

SEQ ID NO: 900 - protein, 15 aa, Homo sapiens
GADHGSGNNFVSPYV

SEQ ID NO: 901 - DNA, 354 bp, Homo sapiens
caggtccagctggtgcagtctggggctgaggtgaagaagccagggtcctcggtgaaggtctcctgcagggaatctggaggcaccttcaacggctacactatcacctgggtgcgacaggcccctgggcaaggccttgagtggatgggagggatcatccctatgatggggacagtcaactacgcacagaagttgcagggcagagtcaccattaccacggactatttcacgaaaacagcctacatggatctgaacaatttaagatctgaagacacggccatgtattattgtgtgaaaatcagatatactgggcagcagctgctctggggccagggaaccctggtcaccgtctcctca

SEQ ID NO: 902 - protein, 118 aa, Homo sapiens
QVQLVQSGAEVKKPGSSVKVSCRESGGTFNGYTITWVRQAPGQGLEWMGGIIPMMGTVNYAQKLQGRVTITTDYFTKTAYMDLNNLRSEDTAMYYCVKIRYTGQQLLWGQGTLVTVSS

SEQ ID NO: 903 - protein, 5 aa, Homo sapiens
GYTIT

SEQ ID NO: 904 - protein, 17 aa, Homo sapiens
GIIPMMGTVNYAQKLQG

SEQ ID NO: 905 - protein, 9 aa, Homo sapiens
IRYTGQQLL

SEQ ID NO: 906 - protein, 6 aa, Homo sapiens
GGTFNG

SEQ ID NO: 907 - protein, 10 aa, Homo sapiens
GIIPMMGTVN

SEQ ID NO: 908 - DNA, 321 bp, Homo sapiens
gacatccagatgacccagtctccttccaccctgtcggcatctataggagacagagtcaccatcacttgccgggccagtcagagtattgcaagttggttggcctggtatcagcaaaaaccagggaaagcccctaagctcctgatctatgaggcagttaatttagaaagtggggtcccatcaaggttcagcggcagtggatctgggacagatttcactctcaccatcagcagcctgcagcccgatgattttgcaacttatttctgccaacattatggtactatttctcagaccttcggcggagggaccaaggtggagatcaaa

SEQ ID NO: 909 - protein, 107 aa, Homo sapiens
DIQMTQSPSTLSASIGDRVTITCRASQSIASWLAWYQQKPGKAPKLLIYEAVNLESGVPSRFSGSGSGTDFTLTISSLQPDDFATYFCQHYGTISQTFGGGTKVEIK

SEQ ID NO: 910 - protein, 11 aa, Homo sapiens
RASQSIASWLA

SEQ ID NO: 911 - protein, 7 aa, Homo sapiens
EAVNLES

SEQ ID NO: 912 - protein, 9 aa, Homo sapiens
QHYGTISQT

SEQ ID NO: 913 - DNA, 360 bp, Homo sapiens
caggtccagctggtgcaatctgggagtgaggtgaagaagcctgggacctcggtgaaggtctcctgcacggcctctggaagtgtcttcaccaattatggaattagttgggtgcgacaggcccctggacaagggcttgagtggatgggagggatcatccctctctttggcgcagccaagtacgcacagaaattccagggcagagtcaccatcacagcggacgaatccacgaagacagtctacatggagctgagcaggctgacatctaaagacacggccatatatttctgtgcgaaggccccccgtgtctacgagtactactttgatcagtggggccagggaaccccagtcaccgtctcctca

SEQ ID NO: 914 - protein, 120 aa, Homo sapiens
QVQLVQSGSEVKKPGTSVKVSCTASGSVFTNYGISWVRQAPGQGLEWMGGIIPLFGAAKYAQKFQGRVTITADESTKTVYMELSRLTSKDTAIYFCAKAPRVYEYYFDQWGQGTPVTVSS

SEQ ID NO: 915 - protein, 5 aa, Homo sapiens
NYGIS

SEQ ID NO: 916 - protein, 17 aa, Homo sapiens
GIIPLFGAAKYAQKFQG

SEQ ID NO: 917 - protein, 11 aa, Homo sapiens
APRVYEYYFDQ

SEQ ID NO: 918 - protein, 6 aa, Homo sapiens
GSVFTN

SEQ ID NO: 919 - protein, 10 aa, Homo sapiens
GIIPLFGAAK

SEQ ID NO: 920 - DNA, 324 bp, Homo sapiens
gaaattgtgttgacgcagtctccaggcaccctgtctttgtctccaggggaaagagccaccctctcctgcagggccagtcagagtgttagcagcagtcaattagcctggtaccagcaaaaacctggccaggctcccaggctcatcatctatggtgcgtccaccagggccactggcatcccagacaggttcagtggaagtgggtctgggacagacttcactctcaccatcggcagactggagcctgaagattttgcagtgtttttctgtcagcagtatagtacctcacctccgacgttcggccaagggaccaaggtggatttcaaa

SEQ ID NO: 921 - protein, 108 aa, Homo sapiens
EIVLTQSPGTLSLSPGERATLSCRASQSVSSSQLAWYQQKPGQAPRLIIYGASTRATGIPDRFSGSGSGTDFTLTIGRLEPEDFAVFFCQQYSTSPPTFGQGTKVDFK

SEQ ID NO: 922 - protein, 12 aa, Homo sapiens
RASQSVSSSQLA

SEQ ID NO: 923 - protein, 9 aa, Homo sapiens
QQYSTSPPT

SEQ ID NO: 924 - DNA, 390 bp, Homo sapiens
caggtgcagctgcagcagtggggcgcaggactgttgaagccttcggagaccctgtccctcacctgcgctgtctatggtgggtccttcagtgtcagtggttactactggagctggatccgccagcccccagggagggggctggagtggattggggaaatcagtcatggtggaagcaccaactacaacccgtccctcaagagtcgagtcaccatatcagtggacacgaccaagaaccagttctccctgagactgagctctgtgaccgccgcggacacggccgtctattactgtgcgagagggacagaccctgacacggaagtatattgtcgtgttggtaactgcgcggcctttgactactggggccagggaagcctggtcaccgtctcctca

SEQ ID NO: 925 - protein, 130 aa, Homo sapiens
QVQLQQWGAGLLKPSETLSLTCAVYGGSFSVSGYYWSWIRQPPGRGLEWIGEISHGGSTNYNPSLKSRVTISVDTTKNQFSLRLSSVTAADTAVYYCARGTDPDTEVYCRVGNCAAFDYWGQGSLVTVSS

SEQ ID NO: 926 - protein, 7 aa, Homo sapiens
VSGYYWS

SEQ ID NO: 927 - protein, 16 aa, Homo sapiens
EISHGGSTNYNPSLKS

SEQ ID NO: 928 - protein, 20 aa, Homo sapiens
GTDPDTEVYCRVGNCAAFDY

SEQ ID NO: 929 - protein, 8 aa, Homo sapiens
GGSFSVSG

SEQ ID NO: 930 - protein, 9 aa, Homo sapiens
EISHGGSTN

SEQ ID NO: 931 - DNA, 327 bp, Homo sapiens
gaaattatattggcgcagtctccaggcaccctgtctttgtctccaggggagagagccaccctctcctgcagggccagccagtttgttagcaccagatccctggcctggtaccagcagagacctggccaggctcccagactcctcatctatggtgcatccagcagggccactggcatcccagacaggttcagtggcagtgggtctgggacagacttcacgctcaccatcagcagactggagcctgaagattttgcagtgtattactgtcagcactatggttactcacctaggtacgcttttggccaggggtccaaggttgagatcaaa

SEQ ID NO: 932 - protein, 109 aa, Homo sapiens
EIILAQSPGTLSLSPGERATLSCRASQFVSTRSLAWYQQRPGQAPRLLIYGASSRATGIPDRFSGSGSGTDFTLTISRLEPEDFAVYYCQHYGYSPRYAFGQGSKVEIK

SEQ ID NO: 933 - protein, 12 aa, Homo sapiens
RASQFVSTRSLA

SEQ ID NO: 934 - protein, 10 aa, Homo sapiens
QHYGYSPRYA

SEQ ID NO: 935 - DNA, 384 bp, Homo sapiens
caggtgcagctccaacagtggggctcaggactgttgaagccttcggagaccctgtccctcacctgcgctgtctatggtgggtccttcagagatgactactggacctggattcgccagcccccaggcaaggggctggagtggattggggaaatcaatcatagtggaagaaccaactacaacccgtccctcaagagtcgagtcaccatatcagtagacacgtccctgaaacagttctccttgaaggtgatttctgtgaccgccgcggacacggctgtttattactgtgcgagagggacgagccatgtttcccggtattttgattggttaccacccaccaactggttcgacccctggggccagggaacccaggtcaccgtctcgagc

SEQ ID NO: 936 - protein, 128 aa, Homo sapiens
QVQLQQWGSGLLKPSETLSLTCAVYGGSFRDDYWTWIRQPPGKGLEWIGEINHSGRTNYNPSLKSRVTISVDTSLKQFSLKVISVTAADTAVYYCARGTSHVSRYFDWLPPTNWFDPWGQGTQVTVSS

SEQ ID NO: 937 - protein, 5 aa, Homo sapiens
DDYWT

SEQ ID NO: 938 - protein, 16 aa, Homo sapiens
EINHSGRTNYNPSLKS

SEQ ID NO: 939 - protein, 20 aa, Homo sapiens
GTSHVSRYFDWLPPTNWFDP

SEQ ID NO: 940 - protein, 6 aa, Homo sapiens
GGSFRD

SEQ ID NO: 941 - protein, 9 aa, Homo sapiens
EINHSGRTN

SEQ ID NO: 942 - DNA, 324 bp, Homo sapiens
gacattgtgttgacgcagtctccaggcaccctgtctttgtctccaggggaaagagccaccctctcctgcagggccagtcagagtgttagcagcagctacttagcctggtaccagcagaaacctggccaggctcccaggctcgtcatgtatggtgcagccaccagggccactggcatcccagacaggttcagtggcagtgggtctgggccagacttcactctcaccatcagcagactggagcctgaagattttgcaatgtattactgtcagcagtatggtaactcaccgatcaccttcggccaagggacacgactggagatcaaa

SEQ ID NO: 943 - protein, 108 aa, Homo sapiens
DIVLTQSPGTLSLSPGERATLSCRASQSVSSSYLAWYQQKPGQAPRLVMYGAATRATGIPDRFSGSGSGPDFTLTISRLEPEDFAMYYCQQYGNSPITFGQGTRLEIK

SEQ ID NO: 944 - protein, 12 aa, Homo sapiens
RASQSVSSSYLA

SEQ ID NO: 945 - protein, 7 aa, Homo sapiens
GAATRAT

SEQ ID NO: 946 - protein, 9 aa, Homo sapiens
QQYGNSPIT

SEQ ID NO: 947 - DNA, 396 bp, Homo sapiens
cagatcaccttgaaggagtctggtcctacactggtgaaacccacacagaccctcacactgacctgcgtcttctctgggttctcactcagcattactggagtgcgtgtgggctggatccgtcagcccccaggaaaggccctggagtggcttgcactcatttcttgggatgatgaaaagcactacagcccatctctgcagagtaggctcaccatcaccaaggacacctccaaaaaccaggtggtccttacaatgaccaacctggaccctgtcgacacagccacatattactgtgcacggtcaaccgacaggggccacgtcttacgatattttggctggatgttaccgggtgatgcatttgatgtctggggccaagggacaatggtcaccgtctcgagc

SEQ ID NO: 948 - protein, 132 aa, Homo sapiens
QITLKESGPTLVKPTQTLTLTCVFSGFSLSITGVRVGWIRQPPGKALEWLALISWDDEKHYSPSLQSRLTITKDTSKNQVVLTMTNLDPVDTATYYCARSTDRGHVLRYFGWMLPGDAFDVWGQGTMVTVSS

SEQ ID NO: 949 - protein, 7 aa, Homo sapiens
ITGVRVG

SEQ ID NO: 950 - protein, 16 aa, Homo sapiens
LISWDDEKHYSPSLQS

SEQ ID NO: 951 - protein, 22 aa, Homo sapiens
STDRGHVLRYFGWMLPGDAFDV

SEQ ID NO: 952 - protein, 8 aa, Homo sapiens
GFSLSITG

SEQ ID NO: 953 - protein, 9 aa, Homo sapiens
LISWDDEKH

SEQ ID NO: 954 - DNA, 339 bp, Homo sapiens
gacatcgtgatgacccagtctccagacttcctgcctgtgtctctgggcgagagggccaccatcaactgcaagtccagccagagagttttatacagctccaacaataaaaactacttagcttggtaccagctgaaaccagggcagcctcctaagttgatcatttattgggcatctacccgggaatccggggtccctgaccgattcagtggcagcgggtctgggacagaattcactctcaccatcagcagcctgcaggctgaagatgtggcagtttattactgtcaacaatattatagtcgtccgtacacttttggccaggggaccaagctcgagatcaaa

SEQ ID NO: 955 - protein, 113 aa, Homo sapiens
DIVMTQSPDFLPVSLGERATINCKSSQRVLYSSNNKNYLAWYQLKPGQPPKLIIYWASTRESGVPDRFSGSGSGTEFTLTISSLQAEDVAVYYCQQYYSRPYTFGQGTKLEIK

SEQ ID NO: 956 - protein, 17 aa, Homo sapiens
KSSQRVLYSSNNKNYLA

SEQ ID NO: 957 - protein, 7 aa, Homo sapiens
WASTRES

SEQ ID NO: 958 - protein, 9 aa, Homo sapiens
QQYYSRPYT

SEQ ID NO: 959 - DNA, 375 bp, Homo sapiens
caggtgcagctggtggagtctgggggaggcgtggtccagcctgggaggtccctgagactctcctgtgcagcctctgaaatcaccttcattacctatgctatgcactgggtccgccaggccccaggcaaggggctggagtgggtggcacttatatcagatgatggaagcaataaattctacgcagactccgtgaagggccgattcaccatctccagagacaattccaagaacacgctgtatctgcaaatgaacagcctgagagctgaggacacggctgcttattactgtgcgagagaaggggtttactttgattcggggacttataggggctactttgactactggggccaggaaaccctggtcaccgtctcgagc

SEQ ID NO: 960 - protein, 125 aa, Homo sapiens
QVQLVESGGGVVQPGRSLRLSCAASEITFITYAMHWVRQAPGKGLEWVALISDDGSNKFYADSVKGRFTISRDNSKNTLYLQMNSLRAEDTAAYYCAREGVYFDSGTYRGYFDYWGQETLVTVSS

SEQ ID NO: 961 - protein, 5 aa, Homo sapiens
TYAMH

SEQ ID NO: 962 - protein, 17 aa, Homo sapiens
LISDDGSNKFYADSVKG

SEQ ID NO: 963 - protein, 16 aa, Homo sapiens
EGVYFDSGTYRGYFDY

SEQ ID NO: 964 - protein, 6 aa, Homo sapiens
EITFIT

SEQ ID NO: 965 - protein, 10 aa, Homo sapiens
LISDDGSNKF

SEQ ID NO: 966 - DNA, 324 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagccactggcctccgatcaccttcggccaagggacacgactggagatcaaa

SEQ ID NO: 967 - protein, 108 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSHWPPITFGQGTRLEIK

SEQ ID NO: 968 - protein, 11 aa, Homo sapiens
RASQSVSSYLA

SEQ ID NO: 969 - protein, 7 aa, Homo sapiens
DASNRAT

SEQ ID NO: 970 - protein, 10 aa, Homo sapiens
QQRSHWPPIT

SEQ ID NO: 971 - DNA, 363 bp, Homo sapiens
caggtgcagctggtacaatctgggggaggcgtggtccagcctgggaggtccctgagactctcctgtgcagcctctggattcaccttcagtagctacgccatgcactgggtccgccaggctccaggcaaggggctggagtgggtggctattatatcatacgacggaaatgatcaatactatacagactccgtgaagggccgattcaccatctccagagacagctccaaagtgtatctccaaatgcacaggctgagacctgaggacacggctgtttattactgtgcgaaagaatttgaaactagtggttattttcatgggagttttgactactggggccagggaatcctggtcaccgtctcgagc

SEQ ID NO: 972 - protein, 121 aa, Homo sapiens
QVQLVQSGGGVVQPGRSLRLSCAASGFTFSSYAMHWVRQAPGKGLEWVAIISYDGNDQYYTDSVKGRFTISRDSSKVYLQMHRLRPEDTAVYYCAKEFETSGYFHGSFDYWGQGILVTVSS

SEQ ID NO: 973 - protein, 5 aa, Homo sapiens
SYAMH

SEQ ID NO: 974 - protein, 17 aa, Homo sapiens
IISYDGNDQYYTDSVKG

SEQ ID NO: 975 - protein, 14 aa, Homo sapiens
EFETSGYFHGSFDY

SEQ ID NO: 976 - protein, 6 aa, Homo sapiens
GFTFSS

SEQ ID NO: 977 - protein, 10 aa, Homo sapiens
IISYDGNDQY

SEQ ID NO: 978 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcttgatttatgaggtcactaattggccctcaggggtttctaatcgcttctctggctccaagtctggcaacacggcctccctgacaatctctgggctccaggctgaggacgaggctgactattactgcagctcatatgcgggcagcagcacttgggtgttcggcggagggaccagggtgaccgttcta

SEQ ID NO: 979 - protein, 110 aa, Homo sapiens
QSALTQPASVSGSPGQSITISCTGTSSDVGGYNYVSWYQQHPGKAPKLLIYEVTNWPSGVSNRFSGSKSGNTASLTISGLQAEDEADYYCSSYAGSSTWVFGGGTRVTVL

SEQ ID NO: 980 - protein, 14 aa, Homo sapiens
TGTSSDVGGYNYVS

SEQ ID NO: 981 - protein, 7 aa, Homo sapiens
EVTNWPS

SEQ ID NO: 982 - protein, 10 aa, Homo sapiens
SSYAGSSTWV

SEQ ID NO: 983 - DNA, 378 bp, Homo sapiens
caggtgcagctgcaggagtcgggcccaggactggtgaagccttcggagaccctgtccctcacctgcactgtctctggtggctccatcaatagttactactggaactggatccggcagcccccagggaagggactggagtggattggctatatctatcacagtgggagcaccaactacaacccctccctcaagagtcgagtcaccatttcggtagacacgtccaagaaccagttctccctgcagctgagctctgtgaccgccgcagacacggccgtgtattactgtgcgagactccggacggactacggtgaccccgactcggtatactactacggtatggacgtctggggccaagggaccacggtcaccgtctcgagc

SEQ ID NO: 984 - protein, 126 aa, Homo sapiens
QVQLQESGPGLVKPSETLSLTCTVSGGSINSYYWNWIRQPPGKGLEWIGYIYHSGSTNYNPSLKSRVTISVDTSKNQFSLQLSSVTAADTAVYYCARLRTDYGDPDSVYYYGMDVWGQGTTVTVSS

SEQ ID NO: 985 - protein, 5 aa, Homo sapiens
SYYWN

SEQ ID NO: 986 - protein, 16 aa, Homo sapiens
YIYHSGSTNYNPSLKS

SEQ ID NO: 987 - protein, 18 aa, Homo sapiens
LRTDYGDPDSVYYYGMDV

SEQ ID NO: 988 - protein, 6 aa, Homo sapiens
GGSINS

SEQ ID NO: 989 - protein, 9 aa, Homo sapiens
YIYHSGSTN

SEQ ID NO: 990 - DNA, 324 bp, Homo sapiens
tcctatgagctgacacagccaccctcggtgtcagtgtccccaggacagacggccaggatcacctgctctggagatgcattgccaaagcaaaatgcttattggtaccagcagaagccaggccaggcccctgtgctgctgatatataaagacagtgagaggccctcagggatccctgagcgattctctggctccagctcagggacaacagtcacgttgaccatcagtggagtccaggcagaggacgaggctgactattactgtcaatcagcagacagcagtggtacttcttgggtgttcggcggagggaccaaactgaccgttcta

SEQ ID NO: 991 - protein, 108 aa, Homo sapiens
SYELTQPPSVSVSPGQTARITCSGDALPKQNAYWYQQKPGQAPVLLIYKDSERPSGIPERFSGSSSGTTVTLTISGVQAEDEADYYCQSADSSGTSWVFGGGTKLTVL

SEQ ID NO: 992 - DNA, 375 bp, Homo sapiens
caggtgcagctgcaggagtcgggcccaggactggtgaagccttcacagaccctgtccctcacctgcactgtctctggtggctccatcagcagtggtaattactactggaactgggtccgccagcacccagggaagggcctggagtggattgggtacatctattacagagggagcaccttctacaacccgtccctcaagagtcgagtgaccatatcaatagacacgtctaagaaccagttctccctgaggctgagctctgtgacggccgcggacacggccgtgtattactgtgcgaaggatacaaggtcgagcctagacaattaccagtacggtatggacgtctggggccaagggaccacggtcaccgtctcgagc

SEQ ID NO: 993 - protein, 125 aa, Homo sapiens
QVQLQESGPGLVKPSQTLSLTCTVSGGSISSGNYYWNWVRQHPGKGLEWIGYIYYRGSTFYNPSLKSRVTISIDTSKNQFSLRLSSVTAADTAVYYCAKDTRSSLDNYQYGMDVWGQGTTVTVSS

SEQ ID NO: 994 - protein, 11 aa, Homo sapiens
SGDALPKQNAY

SEQ ID NO: 995 - protein, 7 aa, Homo sapiens
KDSERPS

SEQ ID NO: 996 - protein, 11 aa, Homo sapiens
QSADSSGTSWV

SEQ ID NO: 997 - protein, 7 aa, Homo sapiens
SGNYYWN

SEQ ID NO: 998 - protein, 16 aa, Homo sapiens
YIYYRGSTFYNPSLKS

SEQ ID NO: 999 - protein, 15 aa, Homo sapiens
DTRSSLDNYQYGMDV

SEQ ID NO: 1000 - protein, 8 aa, Homo sapiens
GGSISSGN

SEQ ID NO: 1001 - protein, 9 aa, Homo sapiens
YIYYRGSTF

SEQ ID NO: 1002 - DNA, 330 bp, Homo sapiens
cagactgtggtgactcaggagccctcactgactgtgtccccaggagggacagtcactctcacctgtgcttccagcactggagcagtcaccagtagttactttccaaactggttccagcagaaacctggacaagcgcccaggccactgatttatagtacaactatcagacactcctggaccccggcccgattctcaggctccctccttgggggcaaagctgccctgacactgtcaggtgtgcagcctgaggacgaggctgactattactgcctgctctactctggtggtgatccagtggctttcggcggagggaccaaactgaccgttcta

SEQ ID NO: 1003 - protein, 110 aa, Homo sapiens
QTVVTQEPSLTVSPGGTVTLTCASSTGAVTSSYFPNWFQQKPGQAPRPLIYSTTIRHSWTPARFSGSLLGGKAALTLSGVQPEDEADYYCLLYSGGDPVAFGGGTKLTVL

SEQ ID NO: 1004 - protein, 14 aa, Homo sapiens
ASSTGAVTSSYFPN

SEQ ID NO: 1005 - protein, 7 aa, Homo sapiens
STTIRHS

SEQ ID NO: 1006 - protein, 10 aa, Homo sapiens
LLYSGGDPVA

SEQ ID NO: 1007 - DNA, 378 bp, Homo sapiens
caggttcatctggtgcagtctggagctgaggtgaggaagcctggggactcagtgaaggtctcctgtaagacttctggttacaccttttccacctatcctgtcgcctgggtgcgacaggtccccggacaagggcttgagtggatgggatggatcagcacttacaatggaaacacaaactttgcacagaacttccagggcagagtcaccctgaccacagacacaaccacgaacacagcctacatggaagtgaggagcctgaaatttgacgacacggccgtctattactgtgcgagagtggaaggctcgtacagggatttttggaataatcaaaacagattcgacccctggggccagggaaccctggtcaccgtctcgagc

SEQ ID NO: 1008 - protein, 126 aa, Homo sapiens
QVHLVQSGAEVRKPGDSVKVSCKTSGYTFSTYPVAWVRQVPGQGLEWMGWISTYNGNTNFAQNFQGRVTLTTDTTTNTAYMEVRSLKFDDTAVYYCARVEGSYRDFWNNQNRFDPWGQGTLVTVSS

SEQ ID NO: 1009 - protein, 5 aa, Homo sapiens
TYPVA

SEQ ID NO: 1010 - protein, 17 aa, Homo sapiens
WISTYNGNTNFAQNFQG

SEQ ID NO: 1011 - protein, 17 aa, Homo sapiens
VEGSYRDFWNNQNRFDP

SEQ ID NO: 1012 - protein, 6 aa, Homo sapiens
GYTFST

SEQ ID NO: 1013 - protein, 10 aa, Homo sapiens
WISTYNGNTN

SEQ ID NO: 1014 - DNA, 318 bp, Homo sapiens
tcctatgtactgactcagccaccctcggtgtcagtggccccaggacagacggccaggatttcctgtgggggaagcaacattggagggaaaagtgtgcactggtaccagcagaagccaggccaggcccctgtgctggtcgtctatgatgatagcggccggccctcagggatccctgagcgattctctggctccaactctggggacacggccaccctgaccatcagcagggtcgaagccggggatgaggccgactatttctgtcaggtgtgggataatttcgggggagtcttcggaactgggaccaaggtcaccgttcta

SEQ ID NO: 1015 - protein, 106 aa, Homo sapiens
SYVLTQPPSVSVAPGQTARISCGGSNIGGKSVHWYQQKPGQAPVLVVYDDSGRPSGIPERFSGSNSGDTATLTISRVEAGDEADYFCQVWDNFGGVFGTGTKVTVL

SEQ ID NO: 1016 - protein, 11 aa, Homo sapiens
GGSNIGGKSVH

SEQ ID NO: 1017 - protein, 7 aa, Homo sapiens
DDSGRPS

SEQ ID NO: 1018 - protein, 9 aa, Homo sapiens
QVWDNFGGV

SEQ ID NO: 1019 - DNA, 369 bp, Homo sapiens
caggtgcagctgcaggagtcgggcccagggctggtgaagccttcggagaccctgtccctcacctgcactgtctctcgtggctccatcggtcattacttctggagctggatccggcagcccccagggaagggactggagtggattggttatatctcttacagtgggagcaccaagtacaacccctccctcaggagtcgagtcaccatatcagtagacacgtccaagaaccagttctccctgaatctgaactctgtcaccgctacggacacggccctatattactgtgcgagagaggattacgatattttgactggggcgggacccggtatggaggtctggggccaagggaccacggtcaccgtctcgagc

SEQ ID NO: 1020 - protein, 123 aa, Homo sapiens
QVQLQESGPGLVKPSETLSLTCTVSRGSIGHYFWSWIRQPPGKGLEWIGYISYSGSTKYNPSLRSRVTISVDTSKNQFSLNLNSVTATDTALYYCAREDYDILTGAGPGMEVWGQGTTVTVSS

SEQ ID NO: 1021 - protein, 5 aa, Homo sapiens
HYFWS

SEQ ID NO: 1022 - protein, 16 aa, Homo sapiens
YISYSGSTKYNPSLRS

SEQ ID NO: 1023 - protein, 15 aa, Homo sapiens
EDYDILTGAGPGMEV

SEQ ID NO: 1024 - protein, 6 aa, Homo sapiens
RGSIGH

SEQ ID NO: 1025 - protein, 9 aa, Homo sapiens
YISYSGSTK

SEQ ID NO: 1026 - DNA, 333 bp, Homo sapiens
cagtctatgttgactcagccaccctcagcgtctgggacccccgggcagagggtcaccatctcttgttctgggagcagctccaacatcggaagtaatactgtcaactggttcaaacatctcccaggaacggcccccaaactcctcatctacagaaatgatctgcggccctcaggggtccctgaccgattctctggctccaagtctggcacctcagcctccctggccatcagtgggctccagtctgaggatgaggctgattattactgtgcaacatgggatgacagcctgaatggtttttatgtcttcggaactgggaccaaagtcaccgttcta

SEQ ID NO: 1027 - protein, 111 aa, Homo sapiens
QSMLTQPPSASGTPGQRVTISCSGSSSNIGSNTVNWFKHLPGTAPKLLIYRNDLRPSGVPDRFSGSKSGTSASLAISGLQSEDEADYYCATWDDSLNGFYVFGTGTKVTVL

SEQ ID NO: 1028 - protein, 13 aa, Homo sapiens
SGSSSNIGSNTVN

SEQ ID NO: 1029 - protein, 7 aa, Homo sapiens
RNDLRPS

SEQ ID NO: 1030 - protein, 12 aa, Homo sapiens
ATWDDSLNGFYV

SEQ ID NO: 1031 - DNA, 384 bp, Homo sapiens
caggtgcagctacagcagtggggcgcaggactgttgaagccttcggagaccctgtccctctcctgcgctgtctttggtgggtccttcagtgattactactggacctggatacgccagcccccagggaaggggctggagtggattggcgaaatcaaacatagtggaagaaccaactacaacccgtcccttgagagtcgagtcaccatatcagtggacacgtccaagaaccagttttccctgaaactgagttctgtgaccgccgcggacacggctatatattattgtgcgagagggacagaccctgacacggagggatattgtcgtagtggtagctgctcggcctttgacttctggggccagggaaccctggtcaccgtctcgagc

SEQ ID NO: 1032 - protein, 128 aa, Homo sapiens
QVQLQQWGAGLLKPSETLSLSCAVFGGSFSDYYWTWIRQPPGKGLEWIGEIKHSGRTNYNPSLESRVTISVDTSKNQFSLKLSSVTAADTAIYYCARGTDPDTEGYCRSGSCSAFDFWGQGTLVTVSS

SEQ ID NO: 1033 - protein, 5 aa, Homo sapiens
DYYWT

SEQ ID NO: 1034 - protein, 16 aa, Homo sapiens
EIKHSGRTNYNPSLES

SEQ ID NO: 1035 - protein, 20 aa, Homo sapiens
GTDPDTEGYCRSGSCSAFDF

SEQ ID NO: 1036 - protein, 6 aa, Homo sapiens
GGSFSD

SEQ ID NO: 1037 - protein, 9 aa, Homo sapiens
EIKHSGRTN

SEQ ID NO: 1038 - DNA, 327 bp, Homo sapiens
gaaattgtgttgacgcagtctccaggcaccctgtctttgtctccaggggaaagagccaccctctcctgcagggccagtcactttgtgaactacaggtccttagcctggtaccagcagacacctggccaggttcccaggctcctcatctatggtgcgtccaccagggccactggcatcccagacaggttcagtggcagtgggtctgggacagacttcactctcaccatcagcagactggagcctgaagattttgcagtgtatttctgtcagcagtatggtggctcacctaggtacacttttggccaggggaccaggctggagatcaaa

SEQ ID NO: 1039 - protein, 109 aa, Homo sapiens
EIVLTQSPGTLSLSPGERATLSCRASHFVNYRSLAWYQQTPGQVPRLLIYGASTRATGIPDRFSGSGSGTDFTLTISRLEPEDFAVYFCQQYGGSPRYTFGQGTRLEIK

SEQ ID NO: 1040 - protein, 12 aa, Homo sapiens
RASHFVNYRSLA

SEQ ID NO: 1041 - protein, 10 aa, Homo sapiens
QQYGGSPRYT

SEQ ID NO: 1042 - DNA, 384 bp, Homo sapiens
caggtgcagctacagcagtggggcgcaggactgttgaagccttcggagaccctgtccctcacctgcggtgtctatggtgggtccctcagtgattactactggagctggatccgccagcccccagggaaggggctggagtggattggagaaatcaatcatagtggaggcaccaactacaatccgtccctcaagagacgagtcaccatatcagtagacacgtcaaagaagcaattctccctgaagatgaactctgtgaccgccgcggacacggctgtatattactgtgcgagagggacagaccctgacacggaagtatattgtcgtgctggtaactgcgcggcctttgacttctggggccagggaaccctggtcaccgtctcgagc

SEQ ID NO: 1043 - protein, 128 aa, Homo sapiens
QVQLQQWGAGLLKPSETLSLTCGVYGGSLSDYYWSWIRQPPGKGLEWIGEINHSGGTNYNPSLKRRVTISVDTSKKQFSLKMNSVTAADTAVYYCARGTDPDTEVYCRAGNCAAFDFWGQGTLVTVSS

SEQ ID NO: 1044 - protein, 5 aa, Homo sapiens
DYYWS

SEQ ID NO: 1045 - protein, 16 aa, Homo sapiens
EINHSGGTNYNPSLKR

SEQ ID NO: 1046 - protein, 20 aa, Homo sapiens
GTDPDTEVYCRAGNCAAFDF

SEQ ID NO: 1047 - protein, 6 aa, Homo sapiens
GGSLSD

SEQ ID NO: 1048 - protein, 9 aa, Homo sapiens
EINHSGGTN

SEQ ID NO: 1049 - DNA, 327 bp, Homo sapiens
gaaattgtgttgacgcagtctccaggcaccctgtctttgtctccaggggagagagccaccctctcctgccgggccagtcactttgttataggcagggctgtagcctggtaccagcagaaacctggccaggctcccaggctcctcatctacggtgcatccagcagggccactggcatcccggacaggttcagtggcagtgggtctgggacagacttcactctcaccatcagcagactggagactgaagattttgctgtgttttactgtcagcactatggtagctcacctaggtacgcttttggccaggggaccaagctggagatcaaa

SEQ ID NO: 1050 - protein, 109 aa, Homo sapiens
EIVLTQSPGTLSLSPGERATLSCRASHFVIGRAVAWYQQKPGQAPRLLIYGASSRATGIPDRFSGSGSGTDFTLTISRLETEDFAVFYCQHYGSSPRYAFGQGTKLEIK

SEQ ID NO: 1051 - protein, 12 aa, Homo sapiens
RASHFVIGRAVA

SEQ ID NO: 1052 - protein, 11 aa, Homo sapiens
QHYGSSPRYAF

SEQ ID NO: 1053 - DNA, 384 bp, Homo sapiens
caggtgcagctgcaggagtcgggcccaggactggtgaagccttcacagaccctgtccctcacctgcactgtctctggtgactccattagtagtgttgatcactactggagctggatccgccaacacccagtgaagggcctggagtggattgggttcatgtattacagtgcgagcacctattacaacccgtccctcaagagtcgagttaccatatcaacggacacgtctaagaaccagttctccctgaggctgagttctgtgactgccgcggacacggccgtatattactgtgcgagaggcacttgtgctggtgactgctcccttcactactactactacggtttggacgtctggggccaagggaggacggtcaccgtctcgagc

SEQ ID NO: 1054 - protein, 128 aa, Homo sapiens
QVQLQESGPGLVKPSQTLSLTCTVSGDSISSVDHYWSWIRQHPVKGLEWIGFMYYSASTYYNPSLKSRVTISTDTSKNQFSLRLSSVTAADTAVYYCARGTCAGDCSLHYYYYGLDVWGQGRTVTVSS

SEQ ID NO: 1055 - protein, 7 aa, Homo sapiens
SVDHYWS

SEQ ID NO: 1056 - protein, 16 aa, Homo sapiens
FMYYSASTYYNPSLKS

SEQ ID NO: 1057 - protein, 18 aa, Homo sapiens
GTCAGDCSLHYYYYGLDV

SEQ ID NO: 1058 - protein, 8 aa, Homo sapiens
GDSISSVD

SEQ ID NO: 1059 - protein, 9 aa, Homo sapiens
FMYYSASTY

SEQ ID NO: 1060 - DNA, 321 bp, Homo sapiens
gacatccagatgacccagtctccatcctccctgtctgcatctgtaggagacagagtcaccatcacttgccgggcaagtcagagcattagcagctatttaaattggtatcagcacaaaccagggaaagcccctaaggtcctgatgtatgctgtatccattttgcaaagtggggtcccatcaaggttcagtggcagtggatctggggcagatttcactctcaccatcagcagtctgcaacctgaagattttgcaacttactactgtcaacagagttacagttccccgctcactttcggcggagggaccaaggtggagatcaaa

SEQ ID NO: 1061 - protein, 107 aa, Homo sapiens
DIQMTQSPSSLSASVGDRVTITCRASQSISSYLNWYQHKPGKAPKVLMYAVSILQSGVPSRFSGSGSGADFTLTISSLQPEDFATYYCQQSYSSPLTFGGGTKVEIK

SEQ ID NO: 1062 - protein, 11 aa, Homo sapiens
RASQSISSYLN

SEQ ID NO: 1063 - protein, 7 aa, Homo sapiens
AVSILQS

SEQ ID NO: 1064 - protein, 9 aa, Homo sapiens
QQSYSSPLT

SEQ ID NO: 1065 - DNA, 396 bp, Homo sapiens
caggtgcagctgcaggagtcgggcccaggactggtgaagccttcggagaccctgtccctcacctgcactgtctctagtggccccatgagtgattattactggagctggatccggcagcccccagggaagggactggagtggattgggcatgtctctgtctctcacggagggaggaccaaatccaatccctccgtcatgagtcgagtcaccatttcagtagaaacgtccaagaaccaattctccctgaaactgacctccgtgaccgctgcggacacggccgtttattactgtgcgagattaaattactatgatagaagtggttatcattcgcctgacggcccctcgaacaactggttcgacccctggggccagggaaccctggtcaccgtctcgagc

SEQ ID NO: 1066 - protein, 132 aa, Homo sapiens
QVQLQESGPGLVKPSETLSLTCTVSSGPMSDYYWSWIRQPPGKGLEWIGHVSVSHGGRTKSNPSVMSRVTISVETSKNQFSLKLTSVTAADTAVYYCARLNYYDRSGYHSPDGPSNNWFDPWGQGTLVTVSS

SEQ ID NO: 1067 - protein, 18 aa, Homo sapiens
HVSVSHGGRTKSNPSVMS

SEQ ID NO: 1068 - protein, 22 aa, Homo sapiens
LNYYDRSGYHSPDGPSNNWFDP

SEQ ID NO: 1069 - protein, 6 aa, Homo sapiens
SGPMSD

SEQ ID NO: 1070 - protein, 11 aa, Homo sapiens
HVSVSHGGRTK

SEQ ID NO: 1071 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgaatcagcggcagcgggtctggggcagatttcactctcaccatcagcagcctgcaggctgaagatgtggcagtttattactgtcagcagtattttgctactcctcggacgttcggccaagggaccaaggtggaaatcaaa

SEQ ID NO: 1072 - protein, 113 aa, Homo sapiens
DIVMTQSPDSLAVSLGERATINCKSSQSVLYSSNNKNYLAWYQQKPGQPPKLLIYWASTRESGVPDRISGSGSGADFTLTISSLQAEDVAVYYCQQYFATPRTFGQGTKVEIK

SEQ ID NO: 1073 - protein, 17 aa, Homo sapiens
KSSQSVLYSSNNKNYLA

SEQ ID NO: 1074 - protein, 9 aa, Homo sapiens
QQYFATPRT

SEQ ID NO: 1075 - DNA, 366 bp, Homo sapiens
caggtacagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtgacacaaactatgcacagaagtttcagggcagggtcaccatgaccagggacacgtccatcaccacagcctacatggagctgagcagcctgagatctgacgacacggccgtgtattactgtgcgagagattccccctatagcagcagctggtccttctttgactactggggccagggacccctggtcaccgtctcgagc

SEQ ID NO: 1076 - protein, 122 aa, Homo sapiens
QVQLVQSGAEVKKPGASVKVSCKASGYTFTGYYMHWVRQAPGQGLEWMGWINPNSGDTNYAQKFQGRVTMTRDTSITTAYMELSSLRSDDTAVYYCARDSPYSSSWSFFDYWGQGPLVTVSS

SEQ ID NO: 1077 - protein, 5 aa, Homo sapiens
GYYMH

SEQ ID NO: 1078 - protein, 17 aa, Homo sapiens
WINPNSGDTNYAQKFQG

SEQ ID NO: 1079 - protein, 13 aa, Homo sapiens
DSPYSSSWSFFDY

SEQ ID NO: 1080 - protein, 6 aa, Homo sapiens
GYTFTG

SEQ ID NO: 1081 - protein, 10 aa, Homo sapiens
WINPNSGDTN

SEQ ID NO: 1082 - DNA, 339 bp, Homo sapiens
gacatcgtgatgacccagtctccagactccctggctgtgtctctgggcgagagggccaccatcaactgcaagtccagccagagtgttttatacagctccaacaataagagccacttagcttggtaccagcagaaaccaggacagcctcctaagttgctcatttactgggcatctacccgggaatccggggtccctgaccgattcagtggcagcgggtctgggacagatttcaccctcatcatcagcagcctgcaggctgaggatgtggcagtttattactgtcagcaatattatttttctcccctcactttcggcggagggaccaaggtggagatcaaa

SEQ ID NO: 1083 - protein, 113 aa, Homo sapiens
DIVMTQSPDSLAVSLGERATINCKSSQSVLYSSNNKSHLAWYQQKPGQPPKLLIYWASTRESGVPDRFSGSGSGTDFTLIISSLQAEDVAVYYCQQYYFSPLTFGGGTKVEIK

SEQ ID NO: 1084 - protein, 17 aa, Homo sapiens
KSSQSVLYSSNNKSHLA

SEQ ID NO: 1085 - protein, 9 aa, Homo sapiens
QQYYFSPLT

SEQ ID NO: 1086 - DNA, 369 bp, Homo sapiens
caggtgcagctgcaggagtcgggcccaggactggtgaagccttcggagaccctgtccctcacctgcactgtctctggtgcctccatcaatagtcactactggagctggatccggcagcccccagggaagggactggagtggattgggtatgtctattacagtgggagcaccacctacaacccctccctcaagagtcgagtcaccttatcagtagatacgtccaagaaccagttctccctgaacctgagctctgtgaccgccgcagacacggccttctattactgtgcgagacatccctacgatgttttgactggttccggggactggttcgacccctggggccagggaaccctggtcaccgtctcgagc

SEQ ID NO: 1087 - protein, 123 aa, Homo sapiens
QVQLQESGPGLVKPSETLSLTCTVSGASINSHYWSWIRQPPGKGLEWIGYVYYSGSTTYNPSLKSRVTLSVDTSKNQFSLNLSSVTAADTAFYYCARHPYDVLTGSGDWFDPWGQGTLVTVSS

SEQ ID NO: 1088 - protein, 5 aa, Homo sapiens
SHYWS

SEQ ID NO: 1089 - protein, 16 aa, Homo sapiens
YVYYSGSTTYNPSLKS

SEQ ID NO: 1090 - protein, 15 aa, Homo sapiens
HPYDVLTGSGDWFDP

SEQ ID NO: 1091 - protein, 7 aa, Homo sapiens
GASINSH

SEQ ID NO: 1092 - protein, 9 aa, Homo sapiens
YVYYSGSTT

SEQ ID NO: 1093 - DNA, 324 bp, Homo sapiens
tcctatgttctgactcaggcaccctcggtgtcagtggccccaggacagacggccaggattacctgtgggggaaatgccattggaagtaaaaaagttcactggtaccagcacaaggcaggccaggcccctgtactcgtcgtctatgatgatacagaccggccctcagggatccctgagcgattctctggctccaactcttggagcacggccaccctgaccatcaacagggtcgaagccggggatgaggccgactattactgtcaggtgtgggattttaccattgatcatgtggtcttcggcggagggaccaagctgaccgttcta

SEQ ID NO: 1094 - protein, 108 aa, Homo sapiens
SYVLTQAPSVSVAPGQTARITCGGNAIGSKKVHWYQHKAGQAPVLVVYDDTDRPSGIPERFSGSNSWSTATLTINRVEAGDEADYYCQVWDFTIDHVVFGGGTKLTVL

SEQ ID NO: 1095 - protein, 11 aa, Homo sapiens
GGNAIGSKKVH

SEQ ID NO: 1096 - protein, 7 aa, Homo sapiens
DDTDRPS

SEQ ID NO: 1097 - protein, 11 aa, Homo sapiens
QVWDFTIDHVV

SEQ ID NO: 1098 - DNA, 387 bp, Homo sapiens
gaggtgcaactggttcagtctggatcagaggtgaaaaagcccggggagtctctgaagatctcctgtaagggttctggctacagctttagcaactactggatcggctgggtgcgccacatgcccgggaaaggcctggaatggatggggatcatttatcctggtgactctgataccagatacagcccgtccttccaaggccaggtcaccatgtcagccgacaagtccagcagcaccgtctacctgcagtggagcagcctgaaggcctcggacaccgccatttattattgtgcgagacggggcggacatagttttggatatgggtcggggggggacacgcacagtgaattcgactcctggggccagggaaccctggtcaccgtctcgagc

SEQ ID NO: 1099 - protein, 129 aa, Homo sapiens
EVQLVQSGSEVKKPGESLKISCKGSGYSFSNYWIGWVRHMPGKGLEWMGIIYPGDSDTRYSPSFQGQVTMSADKSSSTVYLQWSSLKASDTAIYYCARRGGHSFGYGSGGDTHSEFDSWGQGTLVTVSS

SEQ ID NO: 1100 - protein, 5 aa, Homo sapiens
NYWIG

SEQ ID NO: 1101 - protein, 17 aa, Homo sapiens
IIYPGDSDTRYSPSFQG

SEQ ID NO: 1102 - protein, 20 aa, Homo sapiens
RGGHSFGYGSGGDTHSEFDS

SEQ ID NO: 1103 - protein, 6 aa, Homo sapiens
GYSFSN

SEQ ID NO: 1104 - protein, 10 aa, Homo sapiens
IIYPGDSDTR

SEQ ID NO: 1105 - DNA, 330 bp, Homo sapiens
cagtctgtattgacgcagtcgccctcagtgtctgcggccccaggacagaaggtcaccatctcctgctctggaagcgactccaacattggtgattattttgtatgttggtaccagcacctcccaggaaaacccccccaactcctcatctatgaaaataataagcgaccctcagggattcctgaccgattctctggctccaagtctggcacgtcagccaccctgggcatcaccggaatccagaccggggacgaggccgattactactgcgcaacttgggatggcagcctgagtgcttgggtgttcggcggagggaccaagctgaccgttcta

SEQ ID NO: 1106 - protein, 110 aa, Homo sapiens
QSVLTQSPSVSAAPGQKVTISCSGSDSNIGDYFVCWYQHLPGKPPQLLIYENNKRPSGIPDRFSGSKSGTSATLGITGIQTGDEADYYCATWDGSLSAWVFGGGTKLTVL

SEQ ID NO: 1107 - protein, 13 aa, Homo sapiens
SGSDSNIGDYFVC

SEQ ID NO: 1108 - protein, 7 aa, Homo sapiens
ENNKRPS

SEQ ID NO: 1109 - protein, 11 aa, Homo sapiens
ATWDGSLSAWV

SEQ ID NO: 1110 - DNA, 363 bp, Homo sapiens
caggtccaagtggtgcagtctggggctgaggtgaagaagcctgggtcctcggtgagggtctcctgccaggcttctggaggcaccttcatgaattatgctatcatttgggtgcgacgggcccctggacaaggccttgagtggatgggagggatcatccctgtctttcctacaccaaactacgcacagatgttccagggcagagtcacgatttccacggacgaatccaggagcacatccttcttggaactgaccaacctgagatatgaggacacggccgtttattactgtgcgaggcgaatttatcacggtggtaactccggctttgacttctggggccagggaaccctggtcaccgtctcgagc

SEQ ID NO: 1111 - protein, 121 aa, Homo sapiens
QVQVVQSGAEVKKPGSSVRVSCQASGGTFMNYAIIWVRRAPGQGLEWMGGIIPVFPTPNYAQMFQGRVTISTDESRSTSFLELTNLRYEDTAVYYCARRIYHGGNSGFDFWGQGTLVTVSS

SEQ ID NO: 1112 - protein, 5 aa, Homo sapiens
NYAII

SEQ ID NO: 1113 - protein, 17 aa, Homo sapiens
GIIPVFPTPNYAQMFQG

SEQ ID NO: 1114 - protein, 12 aa, Homo sapiens
RIYHGGNSGFDF

SEQ ID NO: 1115 - protein, 6 aa, Homo sapiens
GGTFMN

SEQ ID NO: 1116 - protein, 10 aa, Homo sapiens
GIIPVFPTPN

SEQ ID NO: 1117 - DNA, 327 bp, Homo sapiens
gaaattgtgttgacacagtctccagccaccctgtctttgtctccaggggaaagagccaccctctcctgcagggccagtcagagtgttggcaactacttagcctggtaccaacagaaacctggccaggctcccaggctcctcatctatgattcatccaacagggcccctggcatcccagccaggttcagtggcagtgggtctgggacagacttcactctcaccatcagcagcctcgcgcctgaagattttgcagtttattactgtcagcagcgtagcaagtggcctcccatgtacagttttggccatgggaccaagctggagatcaaa

SEQ ID NO: 1118 - protein, 109 aa, Homo sapiens
EIVLTQSPATLSLSPGERATLSCRASQSVGNYLAWYQQKPGQAPRLLIYDSSNRAPGIPARFSGSGSGTDFTLTISSLAPEDFAVYYCQQRSKWPPMYSFGHGTKLEIK

SEQ ID NO: 1119 - protein, 11 aa, Homo sapiens
RASQSVGNYLA

SEQ ID NO: 1120 - protein, 7 aa, Homo sapiens
DSSNRAP

SEQ ID NO: 1121 - protein, 11 aa, Homo sapiens
QQRSKWPPMYS

SEQ ID NO: 1122 - DNA, 357 bp, Homo sapiens
caggtccaggtggtgcagtctgggactgaggtgaagaagcctgggtcctcggtgaaggtctcctgccagacttctggaggcaggttcatgagttatgctatcacctgggtgcgacaggcccctggacaagggcttgagtggatgggaggcatcgtccctgtcttcggaacagcaaactacgctcagaagttccagggcagagtcacgatcaccacggacgattccacgcgcacagcctatatggagttgagcagcctgagaagtgaggacacggccgtttattactgtgggttccgatacggctctggttacgggtttgactcctggggccagggaaccctggtcaccgtctcgagc

SEQ ID NO: 1123 - protein, 119 aa, Homo sapiens
QVQVVQSGTEVKKPGSSVKVSCQTSGGRFMSYAITWVRQAPGQGLEWMGGIVPVFGTANYAQKFQGRVTITTDDSTRTAYMELSSLRSEDTAVYYCGFRYGSGYGFDSWGQGTLVTVSS

SEQ ID NO: 1124 - protein, 5 aa, Homo sapiens
SYAIT

SEQ ID NO: 1125 - protein, 17 aa, Homo sapiens
GIVPVFGTANYAQKFQG

SEQ ID NO: 1126 - protein, 10 aa, Homo sapiens
RYGSGYGFDS

SEQ ID NO: 1127 - protein, 6 aa, Homo sapiens
GGRFMS

SEQ ID NO: 1128 - protein, 10 aa, Homo sapiens
GIVPVFGTAN

SEQ ID NO: 1129 - DNA, 324 bp, Homo sapiens
gaaattgtattgacgcagtctccaggcaccctgtctttgtctccaggggaaagagccaccctctcctgcagggccagtcagagtgttagtagcagctacttagcctggtatcagaagaaacctggccaggctcccaggctcctcatctatggtgcttccactagggccactggcatcccggaccggttcactggcagtgggtctgggacagacttcactctcagcatcagtagactggagcctgaagattttgcagtgtattactgtcagcactttggtacctcagtcttcactttcggcggagggaccaaggttgagatcaaa

SEQ ID NO: 1130 - protein, 108 aa, Homo sapiens
EIVLTQSPGTLSLSPGERATLSCRASQSVSSSYLAWYQKKPGQAPRLLIYGASTRATGIPDRFTGSGSGTDFTLSISRLEPEDFAVYYCQHFGTSVFTFGGGTKVEIK

SEQ ID NO: 1131 - protein, 9 aa, Homo sapiens
QHFGTSVFT

SEQ ID NO: 1132 - DNA, 360 bp, Homo sapiens
caggtgcagctggtgcagtctggggctgatctgaagaagcctggggcctcagtgaaggtctcctgcaaggcttctggatacaccttcaccgactactatattcactgggtgcgacaggcccctggacaagggcttgagtggatgggatggatcaaccctgaaagtggtgacacaaagtatgcacagaagtttcagggcagggtcaccatgaccagggacacgtccatcaccacagcctacatggagctgggtaggctgagatccgacgacacggccgtgtattactgtgcgagagatgtaagtacgacctggagctggttcgccccctggggccagggaaccctggtcaccgtctcgagc

SEQ ID NO: 1133 - protein, 120 aa, Homo sapiens
QVQLVQSGADLKKPGASVKVSCKASGYTFTDYYIHWVRQAPGQGLEWMGWINPESGDTKYAQKFQGRVTMTRDTSITTAYMELGRLRSDDTAVYYCARDVSTTWSWFAPWGQGTLVTVSS

SEQ ID NO: 1134 - protein, 5 aa, Homo sapiens
DYYIH

SEQ ID NO: 1135 - protein, 17 aa, Homo sapiens
WINPESGDTKYAQKFQG

SEQ ID NO: 1136 - protein, 11 aa, Homo sapiens
DVSTTWSWFAP

SEQ ID NO: 1137 - protein, 6 aa, Homo sapiens
GYTFTD

SEQ ID NO: 1138 - protein, 10 aa, Homo sapiens
WINPESGDTK

SEQ ID NO: 1139 - DNA, 339 bp, Homo sapiens
gacatcgtgatgacccagtctccagactccctggcagtgtctctgggcgagagggccaccatcaactgcaggtccagccagagtattttccacaactccaacaatgagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcggtttatttctgtcagcaatattataatgctccgctcactttcggcggagggaccaaggtggagatcaaa

SEQ ID NO: 1140 - protein, 113 aa, Homo sapiens
DIVMTQSPDSLAVSLGERATINCRSSQSIFHNSNNENYLAWYQQKPGQPPKLLIYWASTRESGVPDRFSGSGSGTDFTLTISSLQAEDVAVYFCQQYYNAPLTFGGGTKVEIK

SEQ ID NO: 1141 - protein, 17 aa, Homo sapiens
RSSQSIFHNSNNENYLA

SEQ ID NO: 1142 - protein, 9 aa, Homo sapiens
QQYYNAPLT

SEQ ID NO: 1143 - DNA, 369 bp, Homo sapiens
caggtgcagctggtgcagtctggggctgaggtgaagaggcctgggtcctcggtgaaggtctcatgcacggcttctggaggcatcttcaggaagaatgcaatcagctgggtgcgacaggcccctggacaaggccttgagtggatgggagggatcatcgcagtctttaacacagcaaattacgcgcagaagttccagaacagagtcaaaattaccgcagacgagtcaggcaatacggcctacatggagctgagcagcctgacatctgacgacacggccgtgtattactgtgcgagtcacccaaaatatttctatggttcggggagttatccggacttctggggccagggaaccctggtcaccgtctcgagc

SEQ ID NO: 1144 - protein, 123 aa, Homo sapiens
QVQLVQSGAEVKRPGSSVKVSCTASGGIFRKNAISWVRQAPGQGLEWMGGIIAVFNTANYAQKFQNRVKITADESGNTAYMELSSLTSDDTAVYYCASHPKYFYGSGSYPDFWGQGTLVTVSS

SEQ ID NO: 1145 - DNA, 330 bp, Homo sapiens
caatctgccctgactcagcctcgctcagtgtccgggtctcctggacagtcaatcaccatctcctgtactggtggcagcagtgatattggtgcttctaactctgtctcctggtaccaacaacacccaggcaaagcccccaaactcgttatttttgatgtcactgagcgaccctcaggggtcccgcatcggttctctggctccaagtctggcaacacggcctccctgaccgtctctgggctccagcctgacgacgaggctgattatttctgctgcgcatatggaggcaaatatcttgtggtcttcggcggagggaccaaggtgaccgttcta

SEQ ID NO: 1146 - protein, 110 aa, Homo sapiens
QSALTQPRSVSGSPGQSITISCTGGSSDIGASNSVSWYQQHPGKAPKLVIFDVTERPSGVPHRFSGSKSGNTASLTVSGLQPDDEADYFCCAYGGKYLVVFGGGTKVTVL

SEQ ID NO: 1147 - protein, 14 aa, Homo sapiens
TGGSSDIGASNSVS

SEQ ID NO: 1148 - DNA, 381 bp, Homo sapiens
caggtgcagctggtgcagtctggggctgaggtgaagaaacctggggcctcagtgaaggtctcctgcaaggcttctggatacaccttcatcggctatgatatgcactgggtgcgacaggcccctggacaagggcttgagtggatgggatggatcaacgctaaaagaggtggcacaaactatgcacaaaagtttcagggcagggtcaccatgaccagggacacgtctatcagcacagcctacatggagctgaacagcctgagatctgacgacacggccgtgtattactgtgcgagaggggtggggtcacgaactacgatttttggagttctcaacccggaatttgactactggggccagggaaccctggtcaccgtctcgagc

SEQ ID NO: 1149 - protein, 127 aa, Homo sapiens
QVQLVQSGAEVKKPGASVKVSCKASGYTFIGYDMHWVRQAPGQGLEWMGWINAKRGGTNYAQKFQGRVTMTRDTSISTAYMELNSLRSDDTAVYYCARGVGSRTTIFGVLNPEFDYWGQGTLVTVSS

SEQ ID NO: 1150 - protein, 5 aa, Homo sapiens
GYDMH

SEQ ID NO: 1151 - protein, 17 aa, Homo sapiens
WINAKRGGTNYAQKFQG

SEQ ID NO: 1152 - protein, 18 aa, Homo sapiens
GVGSRTTIFGVLNPEFDY

SEQ ID NO: 1153 - protein, 6 aa, Homo sapiens
GYTFIG

SEQ ID NO: 1154 - protein, 10 aa, Homo sapiens
WINAKRGGTN

SEQ ID NO: 1155 - DNA, 330 bp, Homo sapiens
cagtctgccctgactcagcctccctccgcgtccgggtctcctggacagtcagtcaccatctcctgcactggatccagcagtgacgttggtggttatgactatgtctcctggtaccaacaacacccaggcaaagcccccaaactcctgatttatgaggtcactaagcggccctcaggggtccctgatcgcttctctggctccaagtctggcaacacggcctccctgaccgtctctgggctccaggctgaggatgaggctgattattactgcagctcatatgcgggcaactacaatcatgtcttcggacctgggaccaaggtcaccgttcta

SEQ ID NO: 1156 - protein, 110 aa, Homo sapiens
QSALTQPPSASGSPGQSVTISCTGSSSDVGGYDYVSWYQQHPGKAPKLLIYEVTKRPSGVPDRFSGSKSGNTASLTVSGLQAEDEADYYCSSYAGNYNHVFGPGTKVTVL

SEQ ID NO: 1157 - protein, 14 aa, Homo sapiens
TGSSSDVGGYDYVS

SEQ ID NO: 1158 - protein, 7 aa, Homo sapiens
EVTKRPS

SEQ ID NO: 1159 - protein, 10 aa, Homo sapiens
SSYAGNYNHV

SEQ ID NO: 1160 - DNA, 354 bp, Homo sapiens
caggtgcagctggtgcagtctggggctgaggtgaagaagcctggggcctcagtgaaggtctcctgcaaggcttctggacacaccttcaccggctactacatacactgggtgcgacaggcccctggacaagggcttgagtggatgggatggatcaaccctgacagtggtgccaccagttctgcacagaactttcagggcagggtcaccatgaccggggacacgtcctctagcacagcctacatggagctgagtaggctgagttttgacgacacggccgtctattactgtgcgagagtactgtttaccagtccttttgacttctggggtgagggaaccctggtcaccgtctcgagc

SEQ ID NO: 1161 - protein, 118 aa, Homo sapiens
QVQLVQSGAEVKKPGASVKVSCKASGHTFTGYYIHWVRQAPGQGLEWMGWINPDSGATSSAQNFQGRVTMTGDTSSSTAYMELSRLSFDDTAVYYCARVLFTSPFDFWGEGTLVTVSS

SEQ ID NO: 1162 - protein, 5 aa, Homo sapiens
GYYIH

SEQ ID NO: 1163 - protein, 17 aa, Homo sapiens
WINPDSGATSSAQNFQG

SEQ ID NO: 1164 - protein, 9 aa, Homo sapiens
VLFTSPFDF

SEQ ID NO: 1165 - protein, 6 aa, Homo sapiens
GHTFTG

SEQ ID NO: 1166 - protein, 10 aa, Homo sapiens
WINPDSGATS

SEQ ID NO: 1167 - DNA, 330 bp, Homo sapiens
caggctgtggtgactcaggagccctcactggctgtgtccccaggagggacagtcactctcacctgtggctccagcactggagctgtcaccaggggtcattatccctattggttccagcagaagcctggccaagcccccagggcactcatttatgatagtgcaggcaacagacactcctggactcccgcccgattctcaggctccctccttgggggcaaagctgccctgaccctttcgggtgcgcagcctgaggatgaggctgagtattactgcttgctctcctatagtggtgtctgggtgttcggcggagggacgaagctgaccgttcta

SEQ ID NO: 1168 - protein, 110 aa, Homo sapiens
QAVVTQEPSLAVSPGGTVTLTCGSSTGAVTRGHYPYWFQQKPGQAPRALIYDSAGNRHSWTPARFSGSLLGGKAALTLSGAQPEDEAEYYCLLSYSGVWVFGGGTKLTVL

SEQ ID NO: 1169 - protein, 14 aa, Homo sapiens
GSSTGAVTRGHYPY

SEQ ID NO: 1170 - protein, 8 aa, Homo sapiens
DSAGNRHS

SEQ ID NO: 1171 - protein, 9 aa, Homo sapiens
LLSYSGVWV

SEQ ID NO: 1172 - DNA, 360 bp, Homo sapiens; identical to SEQ ID NO: 913

SEQ ID NO: 1173 - DNA, 327 bp, Homo sapiens; identical to SEQ ID NO: 861

SEQ ID NO: 1174 - DNA, 351 bp, Homo sapiens
caagagcagctggtgcagtctggggctgaggtgaagaagcctggggcctcagtgaaggtctcctgcaaggcttctagaaagtccttcattggctactatgtacactgggtgcgacaggcccctggacaagggcttgagtggatgggatggatcagccctgacagtgatgccacaaagtacgcacagaagtttcagggctccgtcatcatgaccagggacacgtccgtcagcacagtgtacatggagctgagtaggctgacatctgacgacacggccctttattactgtctcctttttcgaggtggaaactccctctcctggggccagggaaccctggtcaccgtctcgagc

SEQ ID NO: 1175 - protein, 117 aa, Homo sapiens
QEQLVQSGAEVKKPGASVKVSCKASRKSFIGYYVHWVRQAPGQGLEWMGWISPDSDATKYAQKFQGSVIMTRDTSVSTVYMELSRLTSDDTALYYCLLFRGGNSLSWGQGTLVTVSS

SEQ ID NO: 1176 - protein, 5 aa, Homo sapiens
GYYVH

SEQ ID NO: 1177 - protein, 17 aa, Homo sapiens
WISPDSDATKYAQKFQG

SEQ ID NO: 1178 - protein, 8 aa, Homo sapiens
FRGGNSLS

SEQ ID NO: 1179 - protein, 6 aa, Homo sapiens
RKSFIG

SEQ ID NO: 1180 - protein, 10 aa, Homo sapiens
WISPDSDATK

SEQ ID NO: 1181 - DNA, 327 bp, Homo sapiens
caggctgtggtgactcaggagccctcactgactgtgtccccaggagggacagtcaccctcacctgtggctccagcactggacctgtcaccagtggtcattatccctactggttccagcagaagcctggccaagcccccaggacattgatttctgctacatccaacacacactcctggacacctgcccgcttctcaggctccctccttgggggcagagctgccctgaccctttcgggtgcgcagcctgaggatgaggctgactattattgctttctctcctacagtggtgcttgggtgttcggcggagggaccacgctgaccgttcta

SEQ ID NO: 1182 - protein, 109 aa, Homo sapiens
QAVVTQEPSLTVSPGGTVTLTCGSSTGPVTSGHYPYWFQQKPGQAPRTLISATSNTHSWTPARFSGSLLGGRAALTLSGAQPEDEADYYCFLSYSGAWVFGGGTTLTVL

SEQ ID NO: 1183 - protein, 14 aa, Homo sapiens
GSSTGPVTSGHYPY

SEQ ID NO: 1184 - protein, 7 aa, Homo sapiens
ATSNTHS

SEQ ID NO: 1185 - protein, 9 aa, Homo sapiens
FLSYSGAWV

SEQ ID NO: 1186 - DNA, 366 bp, Homo sapiens
gaggtgcagctggtggaatctgggggaggcttggtccagccgggggggtccctgagactctcctgtgcagcctctggatttatctttagaaattactggatgagctgggtccggcaggctccagggaaggggctggagtgggtggccaacataaaacaagatggaagagagaagtactatgtggactctctgaggggccgagtcaacatctccagagacaacgccgagaactcattgtatctgcacatgaacagcctgagagtcgaggacacggctgtttatttctgtgcgagagctcggatggtggtggttactggcgatggttttgatgtctggggccatgggacaatggtcaccgtctcgagc

SEQ ID NO: 1187 - protein, 122 aa, Homo sapiens
EVQLVESGGGLVQPGGSLRLSCAASGFIFRNYWMSWVRQAPGKGLEWVANIKQDGREKYYVDSLRGRVNISRDNAENSLYLHMNSLRVEDTAVYFCARARMVVVTGDGFDVWGHGTMVTVSS

SEQ ID NO: 1188 - protein, 5 aa, Homo sapiens
NYWMS

SEQ ID NO: 1189 - protein, 17 aa, Homo sapiens
NIKQDGREKYYVDSLRG

SEQ ID NO: 1190 - protein, 13 aa, Homo sapiens
ARMVVVTGDGFDV

SEQ ID NO: 1191 - protein, 6 aa, Homo sapiens
GFIFRN

SEQ ID NO: 1192 - protein, 10 aa, Homo sapiens
NIKQDGREKY

SEQ ID NO: 1193 - DNA, 321 bp, Homo sapiens
gacatccagatgacccagtctccatcctccctgtctgcatctgtgggagacagagtcaccatcacttgccgggcaagtcagaatattaagaggtatttcaattggtatcagcagaaaccagggaaagcccctaagctcctgatctatgctgcatccaatttagaaaatggggtcccatcaaggttcagtggcagtggatctgggacagatttcactctcaccatcagcagtctgcaacctgaggattttgcgacttattactgtcagcagagtttcagtaaatcgtggacattcggccaagggaccaacgtggacatcaaa

SEQ ID NO: 1194 - protein, 107 aa, Homo sapiens
DIQMTQSPSSLSASVGDRVTITCRASQNIKRYFNWYQQKPGKAPKLLIYAASNLENGVPSRFSGSGSGTDFTLTISSLQPEDFATYYCQQSFSKSWTFGQGTNVDIK

SEQ ID NO: 1195 - protein, 11 aa, Homo sapiens
RASQNIKRYFN

SEQ ID NO: 1196 - protein, 7 aa, Homo sapiens
AASNLEN

SEQ ID NO: 1197 - protein, 9 aa, Homo sapiens
QQSFSKSWT

SEQ ID NO: 1198 - DNA, 296 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaga

SEQ ID NO: 1199 - DNA, 296 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaga

SEQ ID NO: 1200 - DNA, 294 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggctgggtcaccatgaccagggacacgtccatcagcacagcctacatggagctgagcaggctgagatctgacgacacggccgtgtattactgtgcgaga

SEQ ID NO: 1201 - DNA, 296 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 1202 - DNA, 294 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccacggacgaatccacgagcacagcctacatggagctgagcagcctgagatctgaggacacggccgtgtattactgtgcgaga

SEQ ID NO: 1203 - DNA, 296 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 1204 - DNA, 296 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 1205 - protein, 296 aa, Homo sapiens
CAGGTGCAGCTGGTGCAGTCTGGGGCTGAGGTGAAGAAGCCTGGGGCCTCAGTGAAGGTCTCCTGCAAGGCTTCTGGATACACCTTCACCAGTTATGATATCAACTGGGTGCGACAGGCCACTGGACAAGGGCTTGAGTGGATGGGATGGATGAACCCTAACAGTGGTAACACAGGCTATGCACAGAAGTTCCAGGGCAGAGTCACCATGACCAGGAACACCTCCATAAGCACAGCCTACATGGAGCTGAGCAGCCTGAGATCTGAGGACACGGCCGTGTATTACTGTGCGAGAGG

SEQ ID NO: 1206 - DNA, 297 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacgg

SEQ ID NO: 1207 - DNA, 294 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgaga

SEQ ID NO: 1208 - DNA, 296 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaga

SEQ ID NO: 1209 - DNA, 296 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaaga

SEQ ID NO: 1210 - protein, 296 aa, Homo sapiens
CAGGTGCAGCTGGTGGAGTCTGGGGGAGGCGTGGTCCAGCCTGGGAGGTCCCTGAGACTCTCCTGTGCAGCGTCTGGATTCACCTTCAGTAGCTATGGCATGCACTGGGTCCGCCAGGCTCCAGGCAAGGGGCTGGAGTGGGTGGCAGTTATATCATATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACGGCTGTGTATTACTGTGCGAGAGA

SEQ ID NO: 1211 - DNA, 302 bp, Homo sapiens
gaggtgcagctggtggagtctgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaga

SEQ ID NO: 1212 - DNA, 293 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagaga

SEQ ID NO: 1213 - DNA, 296 bp, Homo sapiens
caggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctccatggacacctctgccagcacagcatacctgcagatcagcagcctaaaggctgaggacatggccatgtattactgtgcgagata

SEQ ID NO: 1214 - DNA, 296 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagaga

SEQ ID NO: 1215 - DNA, 299 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaga

SEQ ID NO: 1216 - DNA, 290 bp, Homo sapiens
caggtgcagctgcaggagtcgggcccaggactggtgaagccttcacagaccctgtccctcacctgcactgtctctggtggctccatcagcagtggtagttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactg

SEQ ID NO: 1217 - DNA, 299 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagaca

SEQ ID NO: 1218 - DNA, 293 bp, Homo sapiens
caggtgcagctacaacagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagg

SEQ ID NO: 1219 - DNA, 284 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggccgtgtattactg

SEQ ID NO: 1220 - DNA, 291 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcattcatagtggaagcaccaactacaacccgtccctcaagagtcgagtcaccatatcagtagacacgtccaagaaccagttctccctgaagctgagctctgtgaccgccgcggacacggctgtgtattactgtgcgaga

SEQ ID NO: 1221 - DNA, 299 bp, Homo sapiens; identical to SEQ ID NO: 1217

SEQ ID NO: 1222 - DNA, 297 bp, Homo sapiens
gaggtgcagctggtggagtctgggggaggcttagtaaagactggaggggtctctgagactctcctgtgcagcctctggattcaccttcagtagctctgctatgcactgggtccaccaggctccaggaaagggtttggagtgggtctcagttattagtacaagtggtgataccgtactctacacagactctgtgaagggctgattcaccatctctagagacaatgcccagaattcactgtatctgcaaatgaacagcctgagagccgacgacatggctgtgtattactgtgtgaaaga

SEQ ID NO: 1223 - DNA, 288 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccaattctccctgaagctgagctctgtgaccgctgcggacacggccgtgtattactgtgcg

SEQ ID NO: 1224 - DNA, 299 bp, Homo sapiens
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaga

SEQ ID NO: 1225 - DNA, 296 bp, Homo sapiens; identical to SEQ ID NO: 1213

SEQ ID NO: 1226 - DNA, 296 bp, Homo sapiens
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaca

SEQ ID NO: 1227 - DNA, 287 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcc

SEQ ID NO: 1228 - DNA, 287 bp, Homo sapiens
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctcc

SEQ ID NO: 1229 - DNA, 287 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcc

SEQ ID NO: 1230 - DNA, 287 bp, Homo sapiens; identical to SEQ ID NO: 1229

SEQ ID NO: 1231 - DNA, 287 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctcc

SEQ ID NO: 1232 - DNA, 302 bp, Homo sapiens
gatgttgtgatgactcagtctccactctccctgcccgtcacccttggacagccggcctccatctcctgcaggtctagtcaaagcctcgtacacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctcc

SEQ ID NO: 1233 - DNA, 287 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcc

SEQ ID NO: 1234 - DNA, 287 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcc

SEQ ID NO: 1235 - DNA, 290 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcc

SEQ ID NO: 1236 - DNA, 305 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcc

SEQ ID NO: 1237 - DNA, 299 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttc

SEQ ID NO: 1238 - DNA, 296 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcc

SEQ ID NO: 1239 - DNA, 296 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatctatgaaaataataagcgaccctcagggattcctgaccgattctctggctccaagtctggcacgtcagccaccctgggcatcaccggactccagactggggacgaggccgattattactgcggaacatgggatagcagcctgagtgctgg

SEQ ID NO: 1240 - DNA, 297 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttc

SEQ ID NO: 1241 - DNA, 297 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctc

SEQ ID NO: 1242 - DNA, 297 bp, Homo sapiens
cagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttc

SEQ ID NO: 1243 - DNA, 284 bp, Homo sapiens
tcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatcc

SEQ ID NO: 1244 - DNA, 282 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggt

SEQ ID NO: 1245 - DNA, 294 bp, Homo sapiens
cagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcag

SEQ ID NO: 1246 - DNA, 294 bp, Homo sapiens
caggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgaccctttcgggtgcgcagcctgaggatgaggctgagtattactgcttgctctcctatagtggtgctcgg

SEQ ID NO: 1247 - DNA, 294 bp, Homo sapiens
caggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcgg

SEQ ID NO: 1248 - DNA, 317 bp, Homo sapiens
cagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcgtgtaacc

SEQ ID NO: 1249 - DNA, 317 bp, Homo sapiens
cagcctgtgctgactcagccaccttctgcatcagcctccctgggagcctcggtcacactcacctgcaccctgagcagcggctacagtaattataaagtggactggtaccagcagagaccagggaagggcccccgatttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcgtgtaacc

SEQ ID NO: 1250 - protein, 11 aa, Influenza A virus
PQREGGRRRKR

SEQ ID NO: 1251 - protein, 6 aa, Influenza A virus
PQTETR

SEQ ID NO: 1252 - protein, 13 aa, Homo sapiens
TGSSSNIAANYVQ

SEQ ID NO: 1253 - protein, 14 aa, Homo sapiens
TGTSSDVGGYNSVS

SEQ ID NO: 1254 - protein, 13 aa, Homo sapiens
TGNSNNVGNQGAA

SEQ ID NO: 1255 - protein, 13 aa, Homo sapiens
TGNSNNVGHQGTA

SEQ ID NO: 1256 - protein, 11 aa, Homo sapiens
GGNNIGGYSVH

SEQ ID NO: 1257 - protein, 11 aa, Homo sapiens
RASQSVSSYLA

SEQ ID NO: 1258 - protein, 12 aa, Homo sapiens
RASQSLSSKYLA

SEQ ID NO: 1259 - protein, 13 aa, Homo sapiens
SGSSSNIGSNTVN

SEQ ID NO: 1260 - protein, 11 aa, Homo sapiens
RASQSISSYLN

SEQ ID NO: 1261 - protein, 13 aa, Homo sapiens
SGGTSNIGRNHVN

SEQ ID NO: 1262 - protein, 12 aa, Homo sapiens
TLSSGHSNYIIA

SEQ ID NO: 1263 - protein, 17 aa, Homo sapiens
GIIPMFGTPNYAQKFQG

SEQ ID NO: 1264 - protein, 17 aa, Homo sapiens
GVIPLFRTASYAQNVQN

SEQ ID NO: 1265 - protein, 17 aa, Homo sapiens
GITGMFGTANYAQKFQG

SEQ ID NO: 1266 - protein, 17 aa, Homo sapiens
GISPMFGTPNYAQKFQG

SEQ ID NO: 1267 - protein, 17 aa, Homo sapiens
GIIGVFGVPKYAQKFQG

SEQ ID NO: 1268 - protein, 17 aa, Homo sapiens
WINPMTGGTNYAQKFQV

SEQ ID NO: 1269 - protein, 17 aa, Homo sapiens
GISPIFRTPKYAQKFQG

SEQ ID NO: 1270 - protein, 17 aa, Homo sapiens
GISPIFRTPKYAQKFQG

SEQ ID NO: 1271 - protein, 17 aa, Homo sapiens
GIIPIFGKPNYAQKFQG

SEQ ID NO: 1272 - protein, 7 aa, Homo sapiens
SNSDRPS

SEQ ID NO: 1273 - protein, 7 aa, Homo sapiens
EDDRRPS

SEQ ID NO: 1274 - protein, 7 aa, Homo sapiens
EVTKRPS

SEQ ID NO: 1275 - protein, 7 aa, Homo sapiens
RNNDRPS

SEQ ID NO: 1276 - protein, 7 aa, Homo sapiens
RNGNRPS

SEQ ID NO: 1277 - protein, 7 aa, Homo sapiens
DDKDRPS

SEQ ID NO: 1278 - protein, 7 aa, Homo sapiens
DASNRAT

SEQ ID NO: 1279 - protein, 7 aa, Homo sapiens
GASSRAT

SEQ ID NO: 1280 - protein, 7 aa, Homo sapiens
SNNQRPS

SEQ ID NO: 1281 - protein, 7 aa, Homo sapiens
AASSLQR

SEQ ID NO: 1282 - protein, 7 aa, Homo sapiens
SNEQRPS

SEQ ID NO: 1283 - protein, 11 aa, Homo sapiens
VNSDGSHTKGD

SEQ ID NO: 1284 - protein, 12 aa, Homo sapiens
SSGYYYGGGFDV

SEQ ID NO: 1285 - protein, 13 aa, Homo sapiens
SSGYHFGRSHFDS

SEQ ID NO: 1286 - protein, 11 aa, Homo sapiens
GLYYYESSLDY

SEQ ID NO: 1287 - protein, 15 aa, Homo sapiens
SPSYICSGGTCVFDH

SEQ ID NO: 1288 - protein, 12 aa, Homo sapiens
EPGYYGKNGFDV

SEQ ID NO: 1289 - protein, 17 aa, Homo sapiens
GASVLRYFDWQPEALDI

SEQ ID NO: 1290 - protein, 14 aa, Homo sapiens
TLSSYQPNNDAFAI

SEQ ID NO: 1291 - protein, 14 aa, Homo sapiens
TLSSYQPNNDAFAI

SEQ ID NO: 1292 - protein, 14 aa, Homo sapiens
DSDAYYYGSGGMDV

SEQ ID NO: 1293 - protein, 10 aa, Homo sapiens
QSYDSLSAYV

SEQ ID NO: 1294 - protein, 10 aa, Homo sapiens
QTYDTNNHAV

SEQ ID NO: 1295 - protein, 10 aa, Homo sapiens
CSYAGHSAYV

SEQ ID NO: 1296 - protein, 11 aa, Homo sapiens
STWDSSLSAVV

SEQ ID NO: 1297 - protein, 11 aa, Homo sapiens
SVWDSSLSAWV

SEQ ID NO: 1298 - protein, 11 aa, Homo sapiens
QVWDSGNDRPL

SEQ ID NO: 1299 - protein, 9 aa, Homo sapiens
QQYGSSPQF

SEQ ID NO: 1300 - protein, 9 aa, Homo sapiens
QQYDGVPRT

SEQ ID NO: 1301 - protein, 11 aa, Homo sapiens
QSYDSRLSASL

SEQ ID NO: 1302 - protein, 9 aa, Homo sapiens
QQYDSSPYT

SEQ ID NO: 1303 - protein, 11 aa, Homo sapiens
ASWDDNLSGWV

SEQ ID NO: 1304 - protein, 9 aa, Homo sapiens
ETWDTKIHV

SEQ ID NO: 1305 - DNA, 369 bp, Homo sapiens
caggtgcagctggtgcagtctggggctgaggtgaagaagcctgggtcctcggtgaaggtctcctgcaaggcttctggaggcaccttcagtgacaatgctatcagctgggtgcgacaggccccaggacaagggcttgagtggatggggggcatcattcctatctttggaaaaccaaactacgcacagaagttccagggcagagtcacgattactgcggacgaatccacgagcacagcctacatggacctgaggagcctgagatctgaggacacggccgtttattactgtgcgagagattcagacgcgtattactatggttcggggggtatggacgtctggggccaaggcaccctggtcaccgtctcctca

SEQ ID NO: 1306 - DNA, 335 bp, Homo sapiens
ctgcctgtgctgactcaatcatcctctgcctctgcttccctgggatcctcggtcaagctcacctgcactctgagcagtgggcatagtaactacatcatcgcatggcatcaacagcagccagggaaggcccctcggtacttgatgaaggttaatagtgatggcagccacaccaagggggacgggatccctgatcgcttctcaggctccagctctggggctgaccgctacctcaccatctccaacctccagtctgaggatgaggctagttatttctgtgagacctgggacactaagattcatgtcttcggaactgggaccaaggtctccgtcctcag

SEQ ID NO: 1307 - protein, 123 aa, Homo sapiens
QVQLVQSGAEVKKPGSSVKVSCKASGGTFSDNAISWVRQAPGQGLEWMGGIIPIFGKPNYAQKFQGRVTITADESTSTAYMDLRSLRSEDTAVYYCARDSDAYYYGSGGMDVWGQGTLVTVSS

SEQ ID NO: 1308 - protein, 111 aa, Homo sapiens
LPVLTQSSSASASLGSSVKLTCTLSSGHSNYIIAWHQQQPGKAPRYLMKVNSDGSHTKGDGIPDRFSGSSSGADRYLTISNLQSEDEASYFCETWDTKIHVFGTGTKVSVL

SEQ ID NO: 1309 - DNA, 363 bp, Homo sapiens
caggtgcagctggtgcagtctggggctgaggtgaagaagcctgggtcctcggtgaaggtctcctgcaaggctcctggaggtatcttcaacaccaatgctttcagctgggtccgacaggcccctggacaaggtcttgagtgggtgggaggggtcatccctttgtttcgaacagcaagctacgcacagaacgtccagggcagagtcaccattaccgcggacgaatccacgaacacagcctacatggagcttaccagcctgagatctgcggacacggccgtgtattactgtgcgagaagtagtggttaccattttaggagtcactttgactcctggggcctgggaaccctggtcaccgtctcctca

SEQ ID NO: 1310 - DNA, 333 bp, Homo sapiens
aattttatgctgactcagccccactctgtgtcggcgtctccggggaagacggtgaccatctcctgcaccggcagcagtggcaacattgccgccaactatgtgcagtggtaccaacaacgtccgggcagtgcccccactactgtgatctatgaggatgaccgaagaccctctggggtccctgatcggttctctggctccatcgacaggtcctccaactctgcctccctcaccatctcaggactgaagactgaggacgaggctgactactactgtcagacttatgataccaacaatcatgctgtgttcggaggaggcacccacctgaccgtcctc

SEQ ID NO: 1311 - protein, 363 aa, Homo sapiens
CAGGTGCAGCTGGTGCAATCTGGGGCTGAGGTGAAGAAGCCTGGGTCCTCGGTGAAGGTCTCCTGCAAGGCTCCTGGAGGTATCTTCAACACCAATGCTTTCAGCTGGGTCCGACAGGCCCCTGGACAAGGTCTTGAGTGGGTGGGAGGGGTCATCCCTTTGTTTCGAACAGCAAGCTACGCACAGAACGTCCAGGGCAGAGTCACCATTACCGCGGACGAATCCACGAACACAGCCTACATGGAGCTTACCAGCCTGAGATCTGCGGACACGGCCGTGTATTACTGTGCGAGAAGTAGTGGTTACCATTTTAGGAGTCACTTTGACTCCTGGGGCCTGGGAACCCTGGTCACCGTCTCCTCA

SEQ ID NO: 1312 - DNA, 330 bp, Homo sapiens
tcctatgagctgactcagccaccctcagcgtctgggaaacacgggcagagggtcaccatctcttgttctggaggcacctccaacatcggacgtaatcatgttaactggtaccagcaactcccaggaacggcccccaaactcctcatctatagtaatgaacagcggccctcaggggtccctgaccgattctctggctccaaatctggcacctccgcctccctggccgtgagtgggctccagtctgaggatgaggctgattattactgtgcatcatgggatgacaacttgagtggttgggtgttcggcggagggaccaagctgaccgtccta

SEQ ID NO: 1313 - protein, 121 aa, Homo sapiens
QVQLVQSGAEVKKPGSSVKVSCKAPGGIFNTNAFSWVRQAPGQGLEWVGGVIPLFRTASYAQNVQGRVTITADESTNTAYMELTSLRSADTAVYYCARSSGYHFRSHFDSWGLGTLVTVSS

SEQ ID NO: 1314 - protein, 111 aa, Homo sapiens
NFMLTQPHSVSASPGKTVTISCTGSSGNIAANYVQWYQQRPGSAPTTVIYEDDRRPSGVPDRFSGSIDRSSNSASLTISGLKTEDEADYYCQTYDTNNHAVFGGGTHLTVL

SEQ ID NO: 1315 - protein, 110 aa, Homo sapiens
SYELTQPPSASGKHGQRVTISCSGGTSNIGRNHVNWYQQLPGTAPKLLIYSNEQRPSGVPDRFSGSKSGTSASLAVSGLQSEDEADYYCASWDDNLSGWVFGGGTKLTVL

SEQ ID NO: 1316 - DNA, 361 bp, Homo sapiens
caggtgcagctggtgcagtctggggctgaggtgaagaagcctgggtcctcggtgaaggtctcctgcaaggcttctggaggcaccttcagcgcttatgctttcacctgggtgcggcaggcccctggacaagggcttgagtggatgggaggcatcaccggaatgtttggcacagcaaactacgcacagaagttccagggcagagtcacgattaccgcggacgaactcacgagcacagcctacatggagttgagctccctgacatctgaagacacggccctttattattgtgcgagaggattgtattactatgagagtagtcttgactattggggccagggaaccctggtcaccgtctcctcag

SEQ ID NO: 1317 - DNA, 330 bp, Homo sapiens
cagtctgtgctgactcagccaccctccgcgtccgggtctcctggacagtcagtcaccatctcctgcactggaaccagcagtgacgttggtggttataactctgtctcctggtaccaacagcacccaggcaaagcccccaaactcatgatttatgaggtcactaagcggccctcaggggtccctgatcgcttctctgcctccaagtctggcaacacggcctccctgaccgtctctgggctccaggctgaggatgaggctgattatttctgctgctcatatgcaggccacagtgcttatgtcttcggaactgggaccaaggtcaccgtcctg

SEQ ID NO: 1318 - DNA, 361 bp, Homo sapiens
caggtgcagctggtgcagtctggggctgaggtgaagaagcctgggtcctcggtgaaggtctcctgcagggcttctggaggcaccttcagcgcttatgctttcacctgggtgcggcaggcccctggacaagggcttgagtggatgggaggcatcaccggaatgtttggcacagcaaactacgcacagaagttccagggcagagtcacgattaccgcggacgaactcacgagcacagcctacatggagttgagctccctgacatctgaagacacggccctttattattgtgcgagaggattgtattactatgagagtagtcttgactattggggccagggaaccctggtcaccgtctcctcag

SEQ ID NO: 1319 - DNA, 324 bp, Homo sapiens
gaaattgtgctgactcagtctccaggcaccctgtctttgtctccaggggaaagagccaccctctcctgcagggccagtcagagtcttagcagcaagtacttagcctggtatcagcagaaacctggccaggctcccaggctcctcatctatggtgcatccagcagggccactggcatcccagacaggttcagtggcagtgggtctgggacagacttcaccctcaccatcagtagactggagcctgaagattttgcagtgtattcctgtcagcagtatgatggcgtacctcggacgttcggccaagggaccacggtggaaatcaaa

SEQ ID NO: 1320 - protein, 120 aa, Homo sapiens
QVQLVQSGAEVKKPGSSVKVSCKASGGTFSAYAFTWVRQAPGQGLEWMGGITGMFGTANYAQKFQGRVTITADELTSTAYMELSSLTSEDTALYYCARGLYYYESSLDYWGQGTLVTVSS

SEQ ID NO: 1321 - protein, 110 aa, Homo sapiens
QSVLTQPPSASGSPGQSVTISCTGTSSDVGGYNSVSWYQQHPGKAPKLMIYEVTKRPSGVPDRFSASKSGNTASLTVSGLQAEDEADYFCCSYAGHSAYVFGTGTKVTVL

SEQ ID NO: 1322 - protein, 108 aa, Homo sapiens
EIVLTQSPGTLSLSPGERATLSCRASQSLSSKYLAWYQQKPGQAPRLLIYGASSRATGIPDRFSGSGSGTDFTLTISRLEPEDFAVYSCQQYDGVPRTFGQGTTVEIK

SEQ ID NO: 1323 - DNA, 372 bp, Homo sapiens
caggtgcagctggtgcagtcaggggctgaggtgaagaagcctgggtcctcggtgaaggtctcctgcacgtcctctgaagtcaccttcagtagttttgctatcagctgggtgcgacaggcccctggacaagggcttgagtggctgggagggatcagccctatgtttggaacacctaattacgcgcagaagttccaaggcagagtcaccattaccgcggaccagtccacgaggacagcctacatggacctgaggagcctgagatctgaggacacggccgtgtattattgtgcgagatctccttcttacatttgttctggtggaacctgcgtctttgaccattggggccagggaaccctggtcaccgtctcctca

SEQ ID NO: 1324 - DNA, 330 bp, Homo sapiens
cagcctgggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataatgaccggccctcagggatctcagagagattctctgcatccaggtcaggaaacacagcctccctgaccattactggactccagcctgaggacgaggctgactattactgctcaacatgggacagcagcctcagtgctgtggtattcggcggagggaccaagctgaccgtccta

SEQ ID NO: 1325 - DNA, 372 bp, Homo sapiens
caggtacagctgcagcagtcaggggctgaggtgaagaagcctgggtcctcggtgaaggtctcctgcacgtcctctgaagtcaccttcagtagttttgctatcagctgggtgcgacaggcccctggacaagggcttgagtggctgggagggatcagccctatgtttggaacacctaattacgcgcagaagttccaaggcagagtcaccattaccgcggaccagtccacgaggacagcctacatggacctgaggagcctgagatctgaggacacggccgtgtattattgtgcgagatctccttcttacatttgttctggtggaacctgcgtctttgaccattggggccagggaaccctggtcaccgtctcctca

SEQ ID NO: 1326 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagaggggtcccatcaaggttcagtggcagtggatctgggacagacttcactctcaccattagcagcctgcagcctgaagattttgcagtgtattactgtcagcagtatgatagttcaccgtacacttttggccaggggaccaaggtagagatcaaa

SEQ ID NO: 1327 - protein, 124 aa, Homo sapiens
QVQLVQSGAEVKKPGSSVKVSCTSSEVTFSSFAISWVRQAPGQGLEWLGGISPMFGTPNYAQKFQGRVTITADQSTRTAYMDLRSLRSEDTAVYYCARSPSYICSGGTCVFDHWGQGTLVTVSS

SEQ ID NO: 1328 - protein, 110 aa, Homo sapiens
QPGLTQPPSVSKGLRQTATLTCTGNSNNVGNQGAAWLQQHQGHPPKLLSYRNNDRPSGISERFSASRSGNTASLTITGLQPEDEADYYCSTWDSSLSAVVFGGGTKLTVL

SEQ ID NO: 1329 - protein, 107 aa, Homo sapiens
DIQMTQSPSSLSASVGDRVTITCRASQSISSYLNWYQQKPGKAPKLLIYAASSLQRGVPSRFSGSGSGTDFTLTISSLQPEDFAVYYCQQYDSSPYTFGQGTKVEIK

SEQ ID NO: 1330 - DNA, 366 bp, Homo sapiens
caggtgcagctggtgcaatctggggctgaagtgaagaagcctggggcctcagtgaaggtctcctgcaagacttctggagtcaccttcagcagctatgctatcagttgggtgcgacaggcccctggacaagggcttgagtggatgggagggatcatcggtgtctttggtgtaccaaagtacgcgcagaacttccagggcagagtcacaattaccgcggacaaaccgacgagtacagtctacatggagctgaacagcctgagagctgaggacacggccgtgtattactgtgcgagagagcccgggtactacgtaggaaagaatggttttgatgtctggggccaagggacaatggtcaccgtctcttca

SEQ ID NO: 1331 - DNA, 330 bp, Homo sapiens
tcctatgagctgactcagccaccctcggtgtccaagggcttgagacagaccgccatactcacctgcactggagacagcaacaatgttggccaccaaggtacagcttggctgcaacaacaccagggccaccctcccaaactcctatcctacaggaatggcaaccggccctcagggatctcagagagattctctgcatccaggtcaggaaatacagcctccctgaccattattggactccagcctgaggacgaggctgactactactgctcagtatgggacagcagcctcagtgcctgggtgttcggcggagggaccaagctgaccgtccta

SEQ ID NO: 1332 - protein, 122 aa, Homo sapiens
QVQLVQSGAEVKKPGASVKVSCKTSGVTFSSYAISWVRQAPGQGLEWMGGIIGVFGVPKYAQNFQGRVTITADKPTSTVYMELNSLRAEDTAVYYCAREPGYYVGKNGFDVWGQGTMVTVSS

SEQ ID NO: 1333 - protein, 110 aa, Homo sapiens
SYELTQPPSVSKGLRQTAILTCTGDSNNVGHQGTAWLQQHQGHPPKLLSYRNGNRPSGISERFSASRSGNTASLTIIGLQPEDEADYYCSVWDSSLSAWVFGGGTKLTVL

SEQ ID NO: 1334 - DNA, 378 bp, Homo sapiens
caggtgcagctggtgcagtctggggctgaggtgaggaagcctggggcctcagtgaaggtctcatgtaaggcttctggatacaccttcaccggttattatattcactgggtgcgacaggcccctggacaaggacttgagtggatgggttggatcaaccctatgactggtggcacaaactatgcacagaagtttcaggtctgggtcaccatgacccgggacacgtccatcaacacagcctacatggaggtgagcaggctgacatctgacgacacggccgtgtattactgtgcgaggggggcttccgtattacgatattttgactggcagcccgaggctcttgatatctggggcctcgggaccacggtcaccgtctcctca

SEQ ID NO: 1335 - DNA, 324 bp, Homo sapiens
cagcctgtgctgactcagccaccctcggtgtcagtggccccaggacagacggccagcattccctgtggggggaacaacattggaggctacagtgtacactggtaccaacaaaagccgggccaggcccccctcttggtcatttatgacgataaagaccggccctcagggatccctgagcgattctctggcgccaactctgggagcacggccaccctgacaatcagcagggtcgaagccggggatgagggcgactactactgtcaggtgtgggatagtggtaatgatcgtccgctgttcggcggagggaccaagctgaccgtccta

SEQ ID NO: 1336 - protein, 126 aa, Homo sapiens
QVQLVQSGAEVRKPGASVKVSCKASGYTFTGYYIHWVRQAPGQGLEWMGWINPMTGGTNYAQKFQVWVTMTRDTSINTAYMEVSRLTSDDTAVYYCARGASVLRYFDWQPEALDIWGLGTTVTVSS

SEQ ID NO: 1337 - protein, 108 aa, Homo sapiens
QPVLTQPPSVSVAPGQTASIPCGGNNIGGYSVHWYQQKPGQAPLLVIYDDKDRPSGIPERFSGANSGSTATLTISRVEAGDEGDYYCQVWDSGNDRPLFGGGTKLTVL

SEQ ID NO: 1338 - DNA, 369 bp, Homo sapiens
caggtgcagctggtgcagtctggggctgaagtgaagaagcctggctcctcggtgaaggtttcctgcaaggcttctggaggccccttcagcatgactgctttcacctggctgcgacaggcccctggacaagggcttgagtggatgggtgggatcagccctatctttcgtacaccgaagtacgcacagaagttccagggcagagtcacgattaccgcggacgaatccacgaacacagccaacatggagctgaccagcctgaaatctgaggacacggccgtgtattactgtgcgagaaccctttcctcctaccaaccgaataatgatgcttttgctatctggggccaagggacaatggtcaccgtctcttca

SEQ ID NO: 1339 - DNA, 318 bp, Homo sapiens
gaaattgtgttgacgcagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagactggagcctgaagattttgcagtctatttctgtcagcagtatggtagctcacctcaattcggccaagggacacgactggagattaaa

SEQ ID NO: 1340 - protein, 123 aa, Homo sapiens
QVQLVQSGAEVKKPGSSVKVSCKASGGPFSMTAFTWLRQAPGQGLEWMGGISPIFRTPKYAQKFQGRVTITADESTNTANMELTSLKSEDTAVYYCARTLSSYQPNNDAFAIWGQGTMVTVSS

SEQ ID NO: 1341 - protein, 106 aa, Homo sapiens
EIVLTQSPATLSLSPGERATLSCRASQSVSSYLAWYQQKPGQAPRLLIYDASNRATGIPARFSGSGSGTDFTLTISRLEPEDFAVYFCQQYGSSPQFGQGTRLEIK

SEQ ID NO: 1342 - DNA, 369 bp, Homo sapiens; identical to SEQ ID NO: 1338

SEQ ID NO: 1343 - DNA, 330 bp, Homo sapiens
ctgcctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaggtcaggcacctcagcctccctggccatcattggactccggcctgaggatgaagctgattattactgtcagtcgtatgacagcaggctcagtgcttctctcttcggaactgggaccacggtcaccgtcctc

SEQ ID NO: 1344 - protein, 123 aa, Homo sapiens; identical to SEQ ID NO: 1340

SEQ ID NO: 1345 - protein, 110 aa, Homo sapiens
LPVLTQPPSASGTPGQRVTISCSGSSSNIGSNTVNWYQQLPGTAPKLLIYSNNQRPSGVPDRFSGSRSGTSASLAIIGLRPEDEADYYCQSYDSRLSASLFGTGTTVTVL

What is claimed is:

1. A composition comprising:

(a) an isolated human monoclonal antibody, wherein said antibody comprises a heavy chain variable region comprising the amino acid sequence of SEQ ID NO: 771 and a light chain variable region comprising the amino acid sequence of SEQ ID NO: 778; and (b) an isolated human monoclonal antibody, wherein said antibody comprises a VH CDR1 region comprising the amino acid sequence of NYYWS (SEQ ID NO: 72); a VH CDR2region comprising the amino acid sequence of FIYYGGNTKYNPSLKS (SEQ ID NO: 74); a VH CDR3 region comprising the amino acid sequence of ASCSGGYCILD (SEQ ID NO: 76); a VL CDR1 region comprising the amino acid sequence of RASQNIYKYLN (SEQ ID NO: 59); a VL CDR2 region comprising the amino acid sequence of AASGLQS (SEQ ID NO: 61); a VL CDR3region comprising the amino acid sequence of and QQSYSPPLT (SEQ ID NO: 63), wherein at least one of the antibodies is directly conjugated to either a detectable label or therapeutic agent.

2. A passive immunization composition comprising the composition of claim 1.

3. A pharmaceutical composition comprising the composition of claim 1 and a pharmaceutical carrier.

* * * * *